United States Patent
Bernett et al.

(10) Patent No.: US 11,377,477 B2
(45) Date of Patent: Jul. 5, 2022

(54) PD-1 TARGETED IL-15/IL-15RALPHA FC FUSION PROTEINS AND USES IN COMBINATION THERAPIES THEREOF

(71) Applicant: Xencor, Inc., Monrovia, CA (US)

(72) Inventors: Matthew Bernett, Monrovia, CA (US); John R. Desjarlais, Pasadena, CA (US); Michael Hedvat, Encino, CA (US); Suzanne Schubbert, Long Beach, CA (US); Christine Bonzon, Los Angeles, CA (US); Rumana Rashid, Temple City, CA (US); Rajat Varma, Bethesda, MD (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 16/600,236

(22) Filed: Oct. 11, 2019

(65) Prior Publication Data
US 2020/0140512 A1 May 7, 2020

Related U.S. Application Data

(60) Provisional application No. 62/744,946, filed on Oct. 12, 2018, provisional application No. 62/784,334, filed on Dec. 21, 2018.

(51) Int. Cl.
| | |
|---|---|
| *C07K 16/28* | (2006.01) |
| *A61K 39/395* | (2006.01) |
| *C07K 14/28* | (2006.01) |
| *C12N 15/63* | (2006.01) |
| *C07K 14/54* | (2006.01) |
| *A61K 38/00* | (2006.01) |

(52) U.S. Cl.
CPC ........ *C07K 14/5443* (2013.01); *A61K 39/395* (2013.01); *C07K 16/2818* (2013.01); *C12N 15/63* (2013.01); *A61K 38/00* (2013.01); *C07K 2317/524* (2013.01); *C07K 2317/526* (2013.01); *C07K 2317/53* (2013.01); *C07K 2319/30* (2013.01)

(58) Field of Classification Search
None
See application file for complete search history.

(56) References Cited

U.S. PATENT DOCUMENTS

| | | |
|---|---|---|
| 5,731,168 A | 3/1998 | Carter et al. |
| 5,821,333 A | 10/1998 | Carter et al. |
| 6,737,056 B1 | 5/2004 | Presta |
| 7,276,585 B2 | 10/2007 | Lazar et al. |
| 7,355,008 B2 | 4/2008 | Stavenhagen et al. |
| 7,632,497 B2 | 12/2009 | Stavenhagen |
| 7,834,152 B2 | 11/2010 | Strom et al. |
| 7,858,081 B2 | 12/2010 | Bernard et al. |
| 7,960,512 B2 | 6/2011 | Stavenhagen et al. |
| 8,003,774 B2 | 8/2011 | Stavenhagen et al. |
| 8,124,084 B2 | 2/2012 | LeFrancois et al. |
| 8,192,737 B2 | 6/2012 | Stavenhagen et al. |
| 8,216,574 B2 | 7/2012 | Stavenhagen |
| 8,216,805 B2 | 7/2012 | Carter et al. |
| 8,309,690 B2 | 11/2012 | Allan et al. |
| 8,592,562 B2 | 11/2013 | Kannan et al. |
| 8,629,245 B2 | 1/2014 | Georgiou et al. |
| 8,679,493 B2 | 3/2014 | Georgiou et al. |
| 8,742,074 B2 | 6/2014 | Behrens et al. |
| 8,871,912 B2 | 10/2014 | Davis et al. |
| 8,940,288 B2 | 1/2015 | LeFrancois et al. |
| 8,940,289 B2 | 1/2015 | Wong et al. |
| 8,951,517 B2 | 2/2015 | Stavenhagen et al. |
| 9,028,815 B2 | 5/2015 | Stavenhagen et al. |
| 9,150,663 B2 | 10/2015 | Labrijn et al. |
| 9,308,258 B2 | 4/2016 | Kannan et al. |
| RE45,992 E | 5/2016 | Behrens et al. |
| 9,365,630 B2 | 6/2016 | LeFrancois et al. |
| 9,371,368 B2 | 6/2016 | LeFrancois et al. |
| 9,464,127 B2 | 10/2016 | Wong et al. |
| 9,493,533 B2 | 11/2016 | Bernard et al. |
| 9,505,848 B2 | 11/2016 | Davis et al. |
| 9,527,926 B2 | 12/2016 | Ho et al. |

(Continued)

FOREIGN PATENT DOCUMENTS

| | | |
|---|---|---|
| EP | 2724728 | 4/2002 |
| EP | 0927254 | 6/2005 |

(Continued)

OTHER PUBLICATIONS

U.S. Appl. No. 15/785,401, 2018-0118805, U.S. Pat. No. 10,501,543, filed Oct. 16, 2017, May 3, 2018, Dec. 10, 2019, Bernett et al.

(Continued)

*Primary Examiner* — Bridget E Bunner
*Assistant Examiner* — Fozia M Hamud
(74) *Attorney, Agent, or Firm* — Kelly A. Plummer; Christopher J. Betti; Morgan, Lewis & Bockius, LLP

(57) ABSTRACT

The present invention is directed to novel PD-1 targeted heterodimeric Fc fusion proteins comprising an IL-15/IL-15Rα Fc-fusion protein and a PD-1 antibody fragment-Fc fusion protein. In some embodiments, the PD-1 targeted IL-15/Rα-Fc fusion proteins are administered to a patient to treat cancer. In some embodiments, the PD-1 targeted IL-15/Rα-Fc fusion proteins are administered in combination with a PD-1 blockade antibody such as nivolumab and/or pembrolizumab. In some embodiments, the PD-1 targeted IL-15/Rα-Fc fusion proteins do not compete with a PD-1 blockade antibody such as nivolumab and/or pembrolizumab for antigen binding.

13 Claims, 207 Drawing Sheets

Specification includes a Sequence Listing.

(56) References Cited

U.S. PATENT DOCUMENTS

| | | |
|---|---|---|
| 9,562,109 B2 | 2/2017 | Von Kreudenstein et al. |
| 9,683,052 B2 | 6/2017 | Blein et al. |
| 9,683,053 B2 | 6/2017 | Blein et al. |
| 9,763,705 B2 | 9/2017 | Faulhaber |
| 9,763,765 B2 | 9/2017 | Horan et al. |
| 9,931,377 B2 | 4/2018 | Pavlakis et al. |
| 9,932,387 B2 | 4/2018 | LeFrancois et al. |
| 9,969,790 B2 | 5/2018 | LeFrancois et al. |
| 10,011,858 B2 | 7/2018 | Igawa et al. |
| 10,138,303 B2 | 11/2018 | Ho et al. |
| 10,350,270 B2 | 7/2019 | McCauley |
| 10,550,185 B2 | 2/2020 | Bernett et al. |
| 2006/0257361 A1 | 11/2006 | Watanabe et al. |
| 2006/0263857 A1 | 11/2006 | LeFrancois et al. |
| 2009/0238791 A1 | 9/2009 | Jacques et al. |
| 2010/0267934 A1 | 10/2010 | Van de Winkel et al. |
| 2011/0054151 A1 | 3/2011 | Lazar et al. |
| 2012/0149876 A1 | 6/2012 | Von Kreudenstein et al. |
| 2012/0177595 A1 | 7/2012 | Wong et al. |
| 2013/0039913 A1 | 2/2013 | Labrijn et al. |
| 2013/0131319 A1 | 5/2013 | Igawa et al. |
| 2013/0178605 A1 | 7/2013 | Blein et al. |
| 2014/0134128 A1 | 5/2014 | Wong et al. |
| 2014/0187753 A1 | 7/2014 | Blein et al. |
| 2014/0199294 A1 | 7/2014 | Mimoto et al. |
| 2014/0288275 A1 | 9/2014 | Moore et al. |
| 2014/0335089 A1 | 11/2014 | Igawa et al. |
| 2014/0356381 A1 | 12/2014 | Moore et al. |
| 2014/0363426 A1 | 12/2014 | Moore et al. |
| 2015/0351275 A1 | 12/2015 | Imbimbo et al. |
| 2016/0068584 A1 | 3/2016 | Bechard et al. |
| 2016/0157951 A1 | 6/2016 | Schoenig et al. |
| 2016/0175459 A1 | 6/2016 | Gey et al. |
| 2016/0184399 A1 | 6/2016 | Bechard et al. |
| 2016/0318986 A1 | 11/2016 | Morisseau et al. |
| 2016/0333067 A1 | 11/2016 | LeFrancois et al. |
| 2016/0347818 A1 | 12/2016 | LeFrancois et al. |
| 2016/0355608 A1 | 12/2016 | Bernett et al. |
| 2016/0367635 A1 | 12/2016 | Wong et al. |
| 2017/0020963 A1 | 1/2017 | Qu et al. |
| 2017/0056874 A1 | 3/2017 | Bechard et al. |
| 2017/0088597 A1 | 3/2017 | Wong et al. |
| 2017/0145078 A1 | 5/2017 | Davis et al. |
| 2017/0151310 A1 | 6/2017 | Felber et al. |
| 2017/0233497 A1 | 8/2017 | Labrijn et al. |
| 2018/0094077 A1 | 4/2018 | Blein et al. |
| 2018/0118805 A1 | 5/2018 | Bernett et al. |
| 2018/0118828 A1 | 5/2018 | Bernett et al. |
| 2018/0118836 A1 | 5/2018 | Bernett et al. |
| 2018/0194860 A1 | 7/2018 | Von Kreudenstein et al. |
| 2018/0200366 A1 | 7/2018 | Wong et al. |
| 2018/0298079 A1 | 10/2018 | LeFrancois et al. |
| 2018/0312560 A1 | 11/2018 | Morisseau et al. |
| 2019/0016778 A1 | 1/2019 | Bernett et al. |
| 2019/0263877 A1 | 8/2019 | Yeung et al. |
| 2020/0247862 A1 | 8/2020 | Bernett et al. |
| 2021/0047407 A1 | 2/2021 | Christian et al. |

FOREIGN PATENT DOCUMENTS

| | | |
|---|---|---|
| EP | 3263581 | 1/2008 |
| EP | 1801119 B1 | 6/2009 |
| EP | 1718670 | 7/2011 |
| EP | 1934353 | 10/2011 |
| EP | 2388266 | 4/2014 |
| EP | 2986312 | 2/2016 |
| EP | 3030262 | 6/2016 |
| EP | 3093295 | 11/2016 |
| EP | 3113858 | 1/2017 |
| EP | 2769984 | 8/2017 |
| EP | 3235830 | 10/2017 |
| EP | 3030575 | 7/2018 |
| EP | 2723869 B1 | 2/2019 |
| EP | 3265478 B1 | 9/2019 |
| EP | 3030262 B1 | 10/2019 |
| EP | 1899364 B1 | 2/2020 |
| WO | WO96027011 | 9/1996 |
| WO | WO1997041232 | 11/1997 |
| WO | WO2001010912 A1 | 2/2001 |
| WO | WO2005014642 A2 | 2/2005 |
| WO | WO2005085282 | 9/2005 |
| WO | WO2006063974 | 6/2006 |
| WO | WO2007001677 | 1/2007 |
| WO | WO2007046006 | 4/2007 |
| WO | WO2007084342 | 7/2007 |
| WO | WO2007110205 | 10/2007 |
| WO | WO2007128563 A1 | 11/2007 |
| WO | WO2007147901 | 12/2007 |
| WO | WO2008143794 | 11/2008 |
| WO | WO2009002562 | 12/2008 |
| WO | WO2009036209 | 3/2009 |
| WO | WO2009089004 | 7/2009 |
| WO | WO2010017103 | 2/2010 |
| WO | WO2011005621 | 1/2011 |
| WO | WO2011020047 A1 | 2/2011 |
| WO | WO2011063348 | 5/2011 |
| WO | WO2011143545 | 11/2011 |
| WO | WO2011131746 | 12/2011 |
| WO | WO2012032080 | 3/2012 |
| WO | WO2012040323 A2 | 3/2012 |
| WO | WO2012146628 | 11/2012 |
| WO | WO2012131555 | 12/2012 |
| WO | WO2012175222 | 12/2012 |
| WO | WO2013/055809 | 4/2013 |
| WO | WO2013107791 A1 | 7/2013 |
| WO | WO2014079000 | 5/2014 |
| WO | WO2014/110601 | 7/2014 |
| WO | WO2014145806 | 9/2014 |
| WO | WO2014145907 | 9/2014 |
| WO | WO2014170032 | 10/2014 |
| WO | WO2014207173 | 12/2014 |
| WO | WO2015018528 | 2/2015 |
| WO | WO2015018529 | 2/2015 |
| WO | WO2015103928 | 7/2015 |
| WO | WO2015131994 | 9/2015 |
| WO | WO2015195163 | 12/2015 |
| WO | WO2016004060 | 1/2016 |
| WO | WO2016086186 | 6/2016 |
| WO | WO2016086189 A2 | 6/2016 |
| WO | WO2016086196 A2 | 6/2016 |
| WO | WO2016095642 | 6/2016 |
| WO | WO2016106159 | 6/2016 |
| WO | WO2016141387 | 9/2016 |
| WO | WO2016142314 | 9/2016 |
| WO | WO2018007919 A1 | 1/2018 |
| WO | WO2018071918 | 4/2018 |
| WO | WO2018071919 | 4/2018 |
| WO | WO2018091661 | 5/2018 |
| WO | WO2019006472 | 1/2019 |
| WO | WO2019204592 | 10/2019 |
| WO | WO2019204665 | 10/2019 |
| WO | WO2020077276 | 4/2020 |

OTHER PUBLICATIONS

U.S. Appl. No. 16/660,028, 2020-0040083, filed Oct. 22, 2019, Feb. 6, 2020, Bernett et al.
U.S. Appl. No. 15/785,393, 2018-0118828, U.S. Pat. No. 10,550,185, filed Oct. 16, 2017, May 3, 2018, Feb. 4, 2020, Bernett et al.
U.S. Appl. No. 16/718,072, 2020-0123259, filed Dec. 17, 2019, Apr. 23, 2020, Bernett et al.
U.S. Appl. No. 16/388,174, 2019-0365861, filed Apr. 18, 2019, Dec. 5, 2019, Bernett et al.
U.S. Appl. No. 16/388,811, 2019-0389933, filed Apr. 18, 2019, Dec. 26, 2019, Bernett et al.
U.S. Appl. No. 16/600,236, 2020-0140512, filed Oct. 11, 2019, May 7, 2020, Bernett et al.
U.S. Appl. No. 16/025,963, 2019-0016778, filed Jul. 2, 2018, Jan. 17, 2019, Bernett et al.
U.S. Appl. No. 16/184,895, 2019-0263909, filed Nov. 8, 2018, Aug. 29, 2019, Bernett et al.
U.S. Appl. No. 16/206,849, 2019-0241638, filed Nov. 30, 2018, Aug. 8, 2019, Bernett et al.

(56) References Cited

OTHER PUBLICATIONS

U.S. Appl. No. 16/388,646, 2019-0352362, filed Apr. 18, 2019, Nov. 21, 2019, Bernett et al.
U.S. Appl. No. 16/388,729, 2019-0359684, filed Apr. 18, 2019, Nov. 28, 2019, Bernett et al.
U.S. Appl. No. 16/592,656, 2020-0216509, filed Oct. 3, 2019, Jul. 9, 2020, Bernett et al.
U.S. Appl. No. 16/798,247, filed Feb. 21, 2020, Moore et al.
U.S. Appl. No. 16/724,118, 2020-0247862, filed Dec. 20, 2019, Aug. 6, 2020, Bernett et al.
U.S. Appl. No. 16/875,878, filed May 15, 2020, Bernett et al.
U.S. Appl. No. 17/062,458, filed Oct. 2, 2020, Bernett et al.
U.S. Appl. No. 17/067,508, filed Oct. 9, 2020, Bernett et al.
Schmid et al., Design and characterisation of a novel interleukin-15 receptor alpha fusion protein and analysis of interleukin-15 complexation., PLoS One. Jul. 26, 2019;14(7):e0219313.
Genbank accession No. U31628, Dec. 19, 1995.
Muller, Dafne, Targeted cancer immunotherapy, Mimicking physiological trans-presentation of IL-15., Oncoimmunology. Oct. 1, 2012; 1(7): 1213-1214.
Garcin et al. High efficiency cell-specific targeting of cytokine activity. Nat Commun 5, 3016 (2014).
Kaspar et al., The antibody-mediated targeted delivery of interleukin-15 and GM-CSF to the tumor neovasculature inhibits tumor growth and metastasis., Cancer Res. May 15, 2007;67(10):4940-8.
Conlon et al., Redistribution, hyperproliferation, activation of natural killer cells and CD8 T cells, and cytokine production during first-in-human clinical trial of recombinant human interleukin-15 in patients with cancer., J Clin Oncol. Jan. 1, 2015;33(1):74-82.
List et al., Immunocytokines: a review of molecules in clinical development for cancer therapy., Clin Pharmacol. 2013; 5(Suppl 1): 29-45.
Gillies et al., Antibody-targeted interleukin 2 stimulates T-cell killing of autologous tumor cells., PNAS Feb. 15, 1992 89 (4) 1428-1432.
Albertini et al. Phase II trial of hu14.18-IL2 for patients with metastatic melanoma., Cancer Immunol Immunother. Dec. 2012;61(12):2261-71.
Ribas et al., Phase I/II open-label study of the biologic effects of the interleukin-2 immunocytokine EMD 273063 (hu14.18-IL2) in patients with metastatic malignant melanoma., J Transl Med. Jul. 29, 2009;7:68.
Hofmann et al., Generation, selection and preclinical characterization of an Fc-optimized FLT3 antibody for the treatment of myeloid leukemia., Leukemia. Jun. 2012;26(6):1228-37.
Kellner et al., Heterodimeric bispecific antibody-derivatives against CD19 and CD16 induce effective antibody-dependent cellular cytotoxicity against B-lymphoid tumor cells., Cancer Lett. Apr. 28, 2011;303(2):128-39.
Skera, Arne, 'Anticalins': a new class of engineered ligand-binding proteins with antibody-like properties., J Biotechnol. Jun. 2001;74(4):257-75.
Skera, Arne, Engineered protein scaffolds for molecular recognition., J Mol Recognit. Jul.-Aug. 2000;13(4):167-87.
Horton et al. Potent in vitro and in vivo activity of an Fc-engineered anti-CD19 monoclonal antibody against lymphoma and leukemia., Cancer Res, 2008, vol. 68, 8049-8057.
Kermer et al., An antibody fusion protein for cancer immunotherapy mimicking IL-15 trans-presentation at the tumor site., Mol Cancer Ther. Jun. 2012;11(6):1279-88.
Ortiz-Sánchez et al., Antibody-cytokine fusion proteins: applications in cancer therapy., Expert Opin Biol Ther. May 2008 ; 8(5): 609-632.
Zhu et al., Novel Human Interleukin-15 Agonists., J Immunol Sep. 15, 2009, 183 (6) 3598-3607.
Xia et al., In vivo effect of recombined IL-15/Fc fusion protein on EAU. Sichuan Da Xue Xue Bao Yi Xue Ban. Nov. 2008;39(6) 944-949.
Wu et al., IL-15Rα-IgG1-Fc Enhances IL-2 and IL-15 Anti-tumor Action through NK and CD8+ T Cells Proliferation and Activation., Journal of Molecular Cell Biology, vol. 2, Issue 4, Aug. 2010, pp. 217-222.
Ridgway et al., 'Knobs-into-holes' engineering of antibody CH3 domains for heavy chain heterodimerization., Protein Engineering, Design and Selection, vol. 9, Issue 7, Jul. 1996, pp. 617-621.
Carter P. Bispecific human IgG by design. J Immunol Methods. Feb. 1, 2001;248(1-2):7-15. doi: 10.1016/s0022-1759(00)00339-2. PMID: 11223065.
Atwell et al., Stable heterodimers from remodeling the domain interface of a homodimer using a phage display library 1.,Journal of Molecular Biology, vol. 270, Issue 1,1997,pp. 26-35, ISSN 0022-2836, https://doi.org/10.1006/jmbi.1997.1116.
Merchant, et al., An efficient route to human bispecific IgG, Nature Biotechnology, 1998, vol. 16, pp. 677-681.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Deshpande et al., (2013), Kinetic analysis of cytokine-mediated receptor assembly using engineered FC heterodimers. Protein Science, 22: 1100-1108. https://doi.org/10.1002/pro.2285.
Dumont et al. Monomeric Fc Fusions. BioDrugs 20, 151-160 (2006). https://doi.org/10.2165/00063030-200620030-00002.
Belladonna et al., (2013) Bioengineering heterodimeric cytokines: turning promiscuous proteins into therapeutic agents, Biotechnology and Genetic Engineering Reviews, 29:2, 149-174, DOI: 10.1080/02648725.2013.801228.
Hinrichs, Christian S., Can interleukin-15 keep its therapeutic promise? Science Translational Medicine Mar. 7, 2018:vol. 10, Issue 431, eaar7532, DOI: 10.1126/scitranslmed.aar7532.
Rubinstein et al., Converting IL-15 to a superagonist by binding to soluble IL-15R{alpha}. Proc Natl Acad Sci U S A. Jun. 13, 2006;103(24):9166-71. doi: 10.1073/pnas.0600240103. Epub Jun. 6, 2006. PMID: 16757567; PMCID: PMC1482584.
Stoklasek et al., Combined IL-15/IL-15Ralpha immunotherapy maximizes IL-15 activity in vivo. J Immunol. Nov. 1, 2006;177(9):6072-80. doi: 10.4049/jimmunol.177.9.6072. PMID: 17056533; PMCID: PMC2847275.
Landolfi NF. A chimeric IL-2/Ig molecule possesses the functional activity of both proteins. J Immunol. Feb. 1, 1991;146(3):915-9. PMID: 1988502.
Zheng et al., Administration of noncytolytic IL-10/Fc in murine models of lipopolysaccharide-induced septic shock and allogeneic islet transplantation., J Immunol May 15, 1995, 154 (10) 5590-5600.
Low, et al., Oral and pulmonary delivery of FSH-Fc fusion proteins via neonatal Fc receptor-mediated transcytosis, Human Reproduction, vol. 20, Issue 7, Jul. 2005, pp. 1805-1813.
Kim et al., Targeting the IL-15 Receptor with an Antagonist IL-15 Mutant/Fcγ2a Protein Blocks Delayed-Type Hypersensitivity., J Immunol Jun. 15, 1998, 160 (12) 5742-5748.
Larrick et al., 2013, Inflammation, Advancing Age and Nutrition. D26 Chapter 28. Trophokines: Novel Therapy for Senescence—Related Fibrosis htto://dx rlo1.ora/10 1016/B978-0-12-397803-5. 00028-9.
Mortier et al., Soluble interleukin-15 receptor alpha (IL-15R alpha)-sushi as a selective and potent agonist of IL-15 action through IL-15R beta/gamma. Hyperagonist IL-15 x IL-15R alpha fusion proteins. J Biol Chem. Jan. 20, 2006;281(3):1612-9. doi: 10.1074/jbc.M508624200. Epub Nov. 11, 2005. PMID: 16284400.
Wu J. IL-15 Agonists: The Cancer Cure Cytokine. J Mol Genet Med. Oct. 28, 2013;7:85. doi: 10.4172/1747-0862.1000085. PMID: 24587813; PMCID: PMC3938108.
C. Spiess et al., J. Biol. 288(37):26583-93 (2013), Development of a D30 Human IgG4 Bispecific Antibody for Dual Targeting of Interleukin-4 (IL-4) and Interleukin-13 (IL-13) Cytokines.
Hopp et al. 1988. "A Short Polypeptide Marker Sequence Useful for Recombinant Protein Identification and Purification" Nat. Biotechnol. 6, 1204-1210.

(56) References Cited

OTHER PUBLICATIONS

Budagian et al., IL-15/IL-15 receptor biology: a guided tour through an expanding universe., Cytokine Growth Factor Rev. Aug. 2006;17(4):259-8.
Bodnar et al., A biophysical approach to IL-2 and IL-15 receptor function: Localization, conformation and interactions., Immunology Letters 116 (2008) 117-125.
Numerof et al., Cytokines as Potential Therapeutic Targets for Inflammatory Skin Diseases., Springer-Verlag, Berlin Heidelberg 2006.
Dumont, Francis J. (2005) Interleukin-2 family cytokines: potential for therapeutic immmunoregulation, Expert Opinion on Therapeutic Patents, 15:5, 521-554.
Savio et al., IL-15: a relevant cytolcine for lymphoid homeostasis and autoimmune diseases., Biotecnologia Ap/icada 2006;23:87-93.
Chappel et al., "Identification of a Secondary Fcγ RI Binding Site within a Genetically Engineered Human IgG Actibody," J. Biol. Chem., 268(33):25124-25131 (Nov. 1993).
Chappel et al., "Identification of the Fcγ receptor class I binding site in human IgG through the use of recombinant IgG1/IgG2 hybrid and point-mutated antibodies," PNAS, USA, 88:9036-9040 (Oct. 1991).
Miranda-Carus et al., IL-15 and the initiation of cell contact-dependent synovial fibroblast-T lymphocyte cross-talk in rheumatoid arthritis: effect of methotrexate., 2004 J. Immunol. 13:1463-1476.
Koka et al, Cutting edge: murine dendritic cells require IL-15R alpha to prime NK cells., 2004 J. Immunol. 173:3594-3598.
Matsumoto et al., On-column refolding and characterization of soluble human interleukin-15 receptor alpha-chain produced in *Escherichia coli.*, Protein Purification and Expression, 2003 64-71.
Schluns et al., Distinct cell types control lymphoid subset development by means of IL-15 and IL-15 receptor alpha expression., 2004, PNAS 101(5):5616-5621.
Wei et al., The Sushi domain of soluble IL-15 receptor alpha is essential for binding IL-15 and inhibiting inflammatory and allogenic responses in vitro and in vivo., 2001, J. Immunol. 167:277-282.
Han et al., IL-15:IL-15 receptor alpha superagonist complex: high-level co-expression in recombinant mammalian cells, purification and characterization., Cytokine. Dec. 2011;56(3):804-10.
Stone et al., Design and characterization of a protein superagonist of IL-15 fused with IL-15Rα and a high-affinity T cell receptor., Biotechnol Prog. 2012; Nov.-Dec.;28(6):1588-97.
Kermer et al., An antibody fusion protein for cancer immunotherapy mimicking IL-15 trans-presentation at the tumor site., Mol Cancer Ther. Jun. 2012;11(6):1279-88.
Kermer et al., Combining Antibody-Directed Presentation of IL-15 and 4-1 BBL in a Trifunctional Fusion Protein for Cancer Immunotherapy, Mol Cancer Ther. Jan. 2014;13(1):112-21.
C. Bergamaschi et al, "Intracellular Interaction of Interleukin-15 with Its Receptor during Production Leads to Mutual Stabilization and Increased Bioactivity", 2008, Journal of Biological Chemistry, vol. 283, No. 7, pp. 4189-4199.
Genbank accession No. NM_172174, 1998.
Genbank accession No. NP_002180, Jul. 4, 2020.
S. Dubois et al, "IL-15Rα Recycles and Presents IL-15 in Trans to Neighbouring Cells", Immunity, vol. 17, 537-547, 2002.
Y Tagaya et al, "Generation of secretable and non-secretable interleukin-15 isoforms through alternate usage of signal peptides", 1997, Proc. Natl. Acad. Sci. USA, vol. 44, 14444-14449.
Genbank accession No. AF031167.1, 1998.
D Anderson et al, "Functional Characterization of the Human IL-15 Receptor α Chain and Close Linkage of IL15RA and IL2RA genes", J. Biol. Chem., vol. 270, No. 50, 29862-29869, 1995.
Mortier E et al, "Natural, Proteolytic Release of a Soluble Form of Human IL-15 Receptor α-Chain That Behaves as a Specific, High Affinity IL-15 Antagonist", J. Immunol 2004; 173: 1681-1688.
Matthew J Bernett et al: Abstract 5565: Potency-reduced IL15/IL15R[alpha] heterodimeric Fe-fusions display enhanced in vivo activity through increased exposure 11 , Cancer Research, vol. 78, No. 13(Suppl) Apr. 18, 2018 (Apr. 18, 2018), pp. 1-2, XP055658295. abstract.
Kowalsky Stacy J et al: "Superagonist IL-15-Armed Oncolytic Virus Elicits Potent Antitumor Immunity and Therapy That are Enhanced with PD-1 Blockade", Molecular Therapy, Nature Publishing Group, GB, vol. 26, No. 10, Oct. 3, 2018 (Oct. 3, 2018), pp. 2476-2486, XP002794091, ISSN: 1525-0024, DOI: 10.1016/J.YMTHE.2018. 07.013 abstract, figures 5 and 6.
John M Wrangle et al: "ALT-803, an IL-15 superagonist, in combination with nivolumab in patients with metastatic non-small cell lung cancer: a non randomised, open-label, phase lb trial", The Lancet Oncology, vol. 19, No. 5, Apr. 5, 2018 (Apr. 5, 2018), pp. 694-704, XP055605963, DOI: 10.1016/S1470-2045(18)30148-7 abstract, figures 2, 3 table 3.
Ha et al., Immunoglobulin Fc Heterodimer Platform Technology: From Design to Applications in Therapeutic Antibodies and Proteins., Front Immunol. 2016; 7: 394. Published online Oct. 6, 2016. doi: 10.3389/fimmu.2016.00394.
Rhode et al., Comparison of the Superagonist Complex, ALT-803, to IL15 as Cancer Immunotherapeutics in Animal Models., Cancer Immunol Res. Jan. 2016;4(1):49-60. doi: 10.1158/2326-6066.CIR-15-0093-T. Epub Oct. 28, 2015.
Steinbacher et al., An Fc-optimized NKG2D-immunoglobulin G Fusion Protein for Induction of Natural Killer Cell Reactivity Against Leukemia., Int J Cancer. Mar. 1, 2015;136(5):1073-84. doi: 10.1002/ijc.29083. Epub Jul. 28, 2014.
Prajapati et al., Functions of NKG2D in CD8 + T Cells: An Opportunity for Immunotherapy., Cell Mol Immunol. May 2018;15(5):470-479. doi: 10.1038/cmi.2017.161. Epub Feb. 5, 2018.
Wells, Additivity of mutational effects in proteins., Biochemistry 1990, 29, 37, 8509-8517.
Bork, Powers and Pitfalls in Sequence Analysis: The 70% Hurdle., Genome Res. 2000. 10:398-400.
Skolnick et al., From Genes to Protein Structure and Function: Novel Applications of Computational Approaches in the Genomic Era., Trends Biotechnol. Jan. 2000;18(1):34-9.
Doerks et al., Protein annotation: detective work for function prediction., Trends in Genetics, 1998 vol. 14, Issue 6, p. 248-250, Jun. 1, 1998.
Tokuriki and Tawflik, Stability effects of mutations and protein evolvability., Current Opinion in Structural Biology 2009, 19: 596-604.
Fabbi et al, Dual Roles of IL-15 in Cancer Biology, Journal of Cytokine Biology, 2016, vol. 1, No. 2, pp. 1-7.
Mathios et al, Therapeutic administration of IL-15 superagonist complex ALT-803 leads to long-term survival and durable antitumor immune response in a murine glioblastoma model., International Journal of Cancer, 2016; vol. 138, pp. 187-194.
Alter et al., Targeted IL-15-based Protein Fusion Complexes as Cancer Immunotherapy Approaches., J Immunological Sci. (2018); 2(1): 15-18.
Bailey et al., New interleukin-15 superagonist (IL-15SA) significantly enhances graft-versus-tumor activity., Oncotarget. Jul. 4, 2017; 8(27): 44366-44378.
Charych et al., NKTR-214, an Engineered Cytokine with Biased IL2 Receptor Binding, Increased Tumor Exposure, and Marked Efficacy in Mouse Tumor Models., Clin Cancer Res; 22(3) Feb. 1, 2016.
Chen et al., A targeted IL-15 fusion protein with potent antitumor activity., (2015) Cancer Biology & Therapy, 16:9, 1415-1421, DOI: 10.1080/15384047.2015.1071739.
Ghasemi et al., Selective targeting of IL-2 to NKG2D bearing cells for improved immunotherapy., Nature Communications vol. 7, Article No. 12878 (2016).
Jochems et al., The multi-functionality of N-809, a novel fusion protein encompassing anti-PD-L1 and the IL-15 superagonist fusion complex., OncoImmunology, 2019, vol. 8, No. 2, e1532764 (15 pages).
Klein et al., Cergutuzumab amunaleukin (CEA-IL2v), a CEAtargeted IL-2 variant-based immunocytokine for combination cancer immunotherapy: Overcoming limitations of aldesleukin and con-

(56) References Cited

OTHER PUBLICATIONS ventional IL-2-based immunocytokines.,(2017) OncoImmunology, 6:3, e1277306, DOI: 10.1080/2162402X.2016.1277306.

Olsen et al., Crystal Structure of the Interleukin-15 * Interleukin-15 Receptor α Complex., The Journal of Biological Chemistry vol. 282, No. 51, pp. 37191-37204, Dec. 21, 2007.

Vallera et al., IL15 Trispecific Killer Engagers (TriKE) Make Natural Killer Cells Specific to CD33 þ Targets While Also Inducing Persistence, In Vivo Expansion, and Enhanced Function., Clin Cancer Res; 22(14) Jul. 15, 2016.

Xu et al., Efficacy and Mechanism-of-Action of a Novel Superagonist Interleukin-15: Interleukin-15 Receptor α Su/Fc Fusion Complex in Syngeneic Murine Models of Multiple Myeloma., Cancer Res; 73(10) May 15, 2013.

Zhu et al., Novel Human Interleukin-15 Agonists., The Journal of Immunology; 2009; vol. 183, No. 6; pp. 1-28.

Bernard et al., Identification of an Interleukin-15α Receptor-binding Site on Human Interleukin-15*., The Journal of Biological Chemistry; 2004; vol. 279, No. 23, pp. 24313-24322.

Robinson et al., The potential and promise of IL-15 in immuno-oncogenic therapies, Immunology Letters, vol. 190, 2017, pp. 159-168.

Lichtenegger et al., Targeting LAG-3 and PD-1 to Enhance T Cell Activation by Antigen-Presenting Cells., Front. Immunol. Feb. 27, 2018; 9: 385; pp. 1-12.

Guo et al., Immunobiology of the IL-15/IL-15Rα complex as an antitumor and antiviral agent., Cytokine Growth Factor Rev. Dec. 2017; 38: 10-21.

Ng et al., Heterodimeric IL15 Treatment Enhances Tumor Infiltration, Persistence, and Effector Functions of Adoptively Transferred Tumor-specific T Cells in the Absence of Lymphodepletion., Clin. Cancer Res. Jun. 2017; 23(11): 2817-30.

Liang et al., Targeting IFNα to tumor by anti-PD-L1 creates feedforward antitumor responses to overcome checkpoint blockade resistance., Nat. Commun. Nov. 2, 2018; 9 (1): 4586.

Chen et al., Therapeutic efficacy of an anti-PD-L1 antibody based immunocytokine in a metastatic mouse model of colorectal cancer., Biochem. Biophys. Res. Commun. Nov. 11, 2016; 480 (2): 160-5.

Kiefer et al., Immunocytokines and bispecific antibodies: two complementary strategies for the selective activation of immune cells at the tumor site., Immunol. Rev. Mar. 2016; 270 (1): 178-92; author manuscript; pp. 1-27.

Sondel et al., Current and Potential Uses of Immunocytokines as Cancer Immunotherapy., Antibodies.; 1: 149-71, 2012.

Kim et al., IL-15 superagonist/IL-15RαSushi-Fc fusion complex (IL-15SA/IL-15RαSu-Fc; ALT-803) markedly enhances specific subpopulations of NK and memory CD8+ T cells, and mediates potent anti-tumor activity against murine breast and colon carcinomas., Oncotarget. Mar. 29, 2016; 7 (13): 16130-45.

Rogers et al., Molecular characterization of immunoglobulin D in mammals: immunoglobulin heavy constant delta genes in dogs, chimpanzees and four old world monkey species., Immunology. May 2006; 118 (1): 88-100.

Rowley J. et al., Inhibition of tumor growth by NK1. 1+ cells and CD8+ T cells activated by IL-15 through receptor β/common γ signaling in trans, The Journal of Immunology, 2008, V. 181, N. 12, p. 8237-8247.

Shen J. et al., Single variable domain-IgG fusion: a novel recombinant approach to Fc domain-containing bispecific antibodies, Journal of Biological Chemistry, 2006, V. 281, N. 16, p. 10706-10714.

Chen X. et al., Fusion protein linkers: property, design and functionality, Advanced drug delivery reviews, 2013, V. 65, N. 10, p. 1357-1369.

Maeda Y. et al., Engineering of functional chimeric protein G-VargulaLuciferase, Analytical biochemistry, 1997, V. 249, N. 2, p. 147-152.

Gasser B. et al., Antibody production with yeasts and filamentous fungi: on the road to large scale? Biotechnology letters, 2007, V. 29, N. 2, p. 201-212.

An Z., Therapeutic monoclonal antibodies: from bench to clinic, John Wiley and Sons, 2011, 896 p., p. 350.

Burns W. R. et al., A high molecular weight melanoma-associated antigen-specific chimeric antigen receptor redirects lymphocytes to target human melanomas, Cancer research, 2010, V. 70, N. 8, p. 3027-3033.

Colman P. M., Effects of amino acid sequence changes on antibody-antigen interactions, Research in Immunology, 1994, V. 145, N. 1, p. 33-36.

Safdari Y. et al., Antibody humanization methods—a review and update, Biotechnology and Genetic Engineering Reviews, 2013, V. 29, N. 2, p. 175-186.

Teplyakov A. et al., Antibody modeling assessment II. Structures and models, Proteins: Structure, Function, and Bioinformatics, 2014, V. 82, N. 8, p. 1563-1582.

Yu et al. Simultaneous blockade of multiple immune system inhibitory checkpoints enhances antitumor activity mediated by interleukin-15 in a murine metastatic colon carcinoma model. Clin Cancer Res. 2010;16(24):6019-6028.

Vincent et al. Tumor targeting of the IL-15 superagonist RLI by an anti-GD2 antibody strongly enhances its antitumor potency. Int J Cancer. 2013;133(3):757-765.

Vincent et al. CS14-6. Development of two IL15 immunocytokines targeting either GD2- or CD20-tumoral bearing cells. Cytokine. 2011;56 (1):102.

Xu et al. The tumor immunosuppressive microenvironment impairs the therapy of anti-HER2/neu antibody. Protein Cell. 2012;3(6):441-449.

Bessard et al. High antitumor activity of RLI, an interleukin-15 (IL-15)-IL-15 receptor alpha fusion protein, in metastatic melanoma and colorectal cancer. Mol Cancer Ther. 2009;8(9):2736-2745.

Yu et al., "Simultaneous inhibition of two regulatory T-cell subsets enhanced Interleukin-15 efficacy in a prostate tumor model.", Proc Natl Acad Sci USA. 2012;109(16):6187-6192.

Perdreau et al. "Different dynamics of IL-15R activation following IL-15 cis- or trans-presentation." Eur Cytokine Netw. Dec. 2010;21(4):297-307.

Desbois et al. "IL-15 Trans-Signaling with the Superagonist RLI Promotes Effector/Memory CD8+ T Cell Responses and Enhances Antitumor Activity of PD-1 Antagonists.", J Immunol. Jul. 1, 2016;197(1):168-78. doi: 10.4049/jimmunol.1600019. Epub May 23, 2016.

Intlekofer et al., "At the Bench: Preclinical rationale for CTLA-4 and PD-1 blockade as cancer immunotherapy", Journal of Leukocyte Biology, vol. 94, Jul. 2013, pp. 25-39.

Melero et al.: "Evolving synergistic combinations of targeted immunotherapies to combat cancer", Nature Reviews, Cancer, vol. 15, 2015, pp. 457-472.

Waldmann: "The biology of interleukin-2 and interleukin-15: implications for cancer therapy and vaccine design", 2006, Nat Rev Immunol 6(8): 595-601.

Dubois et al., Preassociation of IL-15 with IL-15Rα-IgG1-Fc Enhances Its Activity on Proliferation of NK and CD8+/CD44high T Cells and Its Antitumor Action., J Immunol Feb. 15, 2008, 180 (4) 2099-2106; DOI: https://doi.org/10.4049/jimmunol.180.4.2099.

Figure 1A

Human IL-15 precursor sequence

>sp|P40933 (SEQ ID NO:1)
MRISKPHLRSISIQCYLCLLLNSHFLTEAGIHVFILGCFSAGLPKTEANWVNVISDLKKIEDLIQSMHIDATLYTES
DVHPSCKVTAMKCFLLELQVISLESGDASIHDTVENLIILANNSLSSNGNVTESGCKECEELEEKNIKEFLQSFVHI
VQMFINTS

Human IL-15 mature form sequence

>sp|P40933|49-162 (SEQ ID NO:2)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Human IL-15Rα, extracellular domain

>sp|Q13261|31-205 (SEQ ID NO:3)
ITCPPPMSVEHADIWVKSYSLYSRERYICNSGFKRKAGTSSLTECVLNKATNVAHWTTPSLKCIRDPALVHQRPAPP
STVTTAGVTPQPESLSPSGKEPAASSPSSNNTAATTAAIVPGSQLMPSKSPSTGTTEISSHESSHGTPSQTTAKNWE
LTASASHQPPGVYPQGHSDTT

Human IL-15Rα, sushi domain

>sp|Q13261|31-95 (SEQ ID NO:4)
ITCPPPMSVEHADIWVKSYSLYSRERYICNSGFKRKAGTSSLTECVLNKATNVAHWTTPSLKCIR

Human IL-15Rα sequence

>sp|Q13261 (SEQ ID NO:12)
MAPRRARGCRTLGLPALLLLLLLRPPATRGITCPPPMSVEHADIWVKSYSLYSRERYICNSGFKRKAGTSSLTECVL
NKATNVAHWTTPSLKCIRDPALVHQRPAPPSTVTTAGVTPQPESLSPSGKEPAASSPSSNNTAATTAAIVPGSQLMP
SKSPSTGTTEISSHESSHGTPSQTTAKNWELTASASHQPPGVYPQGHSDTTVAISTSTVLLCGLSAVSLLACYLKSR
QTPPLASVEMEAMEALPVTWGTSSRDEDLENCSHHL

Human IL-15Rß sequence

>sp|P14784 (SEQ ID NO:13)
MAAPALSWRLPLLILLLPLATSWASAAVNGTSQFTCFYNSRANISCVWSQDGALQDTSCQVHAWPDRRRWNQTCELL
PVSQASWACNLILGAPDSQKLTTVDIVTLRVLCREGVRWRVMAIQDFKPFENLRLMAPISLQVVHVETHRCNISWEI
SQASHYFERHLEFEARTLSPGHTWEEAPLLTLKQKQEWICLETLTPDTQYEFQVRVKPLQGEFTTWSPWSQPLAFRT
KPAALGKDTIPWLGHLLVGLSGAFGFIILVYLLINCRNTGPWLKKVLKCNTPDPSKFFSQLSSEHGGDVQKWLSSPF
PSSSFSPGGLAPEISPLEVLERDKVTQLLLQQDKVPEPASLSSNHSLTSCFTNQGYFFFHLPDALEIEACQVYFTYD
PYSEEDPDEGVAGAPTGSSPQPLQPLSGEDDAYCTFPSRDDLLLFSPSLLGGPSPPSTAPGGSGAGEERMPPSLQER
VPRDWDPQPLGPPTPGVPDLVDFQPPPELVLREAGEEVPDAGPREGVSFPWSRPPGQGEFRALNARLPLNTDAYLSL
QELQGQDPTHLV

Human IL-15Rß, extracellular domain

>sp|P14784|27-240 (SEQ ID NO:14)
AVNGTSQFTCFYNSRANISCVWSQDGALQDTSCQVHAWPDRRRWNQTCELLPVSQASWACNLILGAPDSQKLTTVDI
VTLRVLCREGVRWRVMAIQDFKPFENLRLMAPISLQVVHVETHRCNISWEISQASHYFERHLEFEARTLSPGHTWEE
APLLTLKQKQEWICLETLTPDTQYEFQVRVKPLQGEFTTWSPWSQPLAFRTKPAALGKDT

Figure 1B

Human common gamma chain sequence

>sp|P31785 (SEQ ID NO:15)
MLKPSLPFTSLLFLQLPLLGVGLNTTILTPNGNEDTTADFFLTTMPTDSLSVSTLPLPEVQCFVFNVEYMNCTWNSS
SEPQPTNLTLHYWYKNSDNDKVQKCSHYLFSEEITSGCQLQKKEIHLYQTFVVQLQDPREPRRQATQMLKLQNLVIP
WAPENLTLHKLSESQLELNWNNRFLNHCLEHLVQYRTDWDHSWTEQSVDYRHKFSLPSVDGQKRYTFRVRSRFNPLC
GSAQHWSEWSHPIHWGSNTSKENPFLFALEAVVISVGSMGLIISLLCVYFWLERTMPRIPTLKNLEDLVTEYHGNFS
AWSGVSKGLAESLQPDYSERLCLVSEIPPKGGALGEGPGASPCNQHSPYWAPPCYTLKPET

Human common gamma chain, extracellular domain

>sp|P31785|23-262 (SEQ ID NO:16)
LNTTILTPNGNEDTTADFFLTTMPTDSLSVSTLPLPEVQCFVFNVEYMNCTWNSSSEPQPTNLTLHYWYKNSDNDKV
QKCSHYLFSEEITSGCQLQKKEIHLYQTFVVQLQDPREPRRQATQMLKLQNLVIPWAPENLTLHKLSESQLELNWNN
RFLNHCLEHLVQYRTDWDHSWTEQSVDYRHKFSLPSVDGQKRYTFRVRSRFNPLCGSAQHWSEWSHPIHWGSNTSKE
NPFLFALEA

Figure 2

Human PD-1 sequence

\>sp|Q15116 (SEQ ID NO:17)
MQIPQAPWPVVWAVLQLGWRPGWFLDSPDRPWNPPTFSPALLVVTEGDNATFTCSFSNTSESFVLNWYRMSPSNQTD
KLAAFPEDRSQPGQDCRFRVTQLPNGRDFHMSVVRARRNDSGTYLCGAISLAPKAQIKESLRAELRVTERRAEVPTA
HPSPSPRPAGQFQTLVVGVVGGLLGSLVLLVWVLAVICSRAARGTIGARRTGQPLKEDPSAVPVFSVDYGELDFQWR
EKTPEPPVPCVPEQTEYATIVFPSGMGTSSPARRGSADGPRSAQPLRPEDGHCSWPL

Human PD-1 sequence, extracellular domain

\>sp|Q15116|21-170 (SEQ ID NO:18)
PGWFLDSPDRPWNPPTFSPALLVVTEGDNATFTCSFSNTSESFVLNWYRMSPSNQTDKLAAFPEDRSQPGQDCRFRV
TQLPNGRDFHMSVVRARRNDSGTYLCGAISLAPKAQIKESLRAELRVTERRAEVPTAHPSPSPRPAGQFQTLV

Macaca fascicularis PD-1 sequence

\>tr|B0LAJ3 (SEQ ID NO:19)
MQIPQAPWPVVWAVLQLGWRPGWFLESPDRPWNAPTFSPALLLVTEGDNATFTCSFSNASESFVLNWYRMSPSNQTD
KLAAFPEDRSQPGQDCRFRVTRLPNGRDFHMSVVRARRNDSGTYLCGAISLAPKAQIKESLRAELRVTERRAEVPTA
HPSPSPRPAGQFQALVVGVVGGLLGSLVLLVWVLAVICSRAAQGTIEARRTGQPLKEDPSAVPVFSVDYGELDFQWR
EKTPEPPAPCVPEQTEYATIVFPSGLGTSSPARRGSADGPRSPRPLRPEDGHCSWPL

Macaca fascicularis PD-1 sequence, extracellular domain (predicted)

\>tr|B0LAJ3|21-170 (SEQ ID NO:20)
PGWFLESPDRPWNAPTFSPALLLVTEGDNATFTCSFSNASESFVLNWYRMSPSNQTDKLAAFPEDRSQPGQDCRFRV
TRLPNGRDFHMSVVRARRNDSGTYLCGAISLAPKAQIKESLRAELRVTERRAEVPTAHPSPSPRPAGQFQALV

Figure 3A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 3B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 3C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 3D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 3E

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| K247Q/R355Q/Q419E/K447_ | P217R/P228R/N276K |
| K247Q/R355Q/Q419E/K447_ | N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 4

| Variant constant region | Substitutions |
|---|---|
| pI_ISO(-) | I199T/N203D/K274Q/R355Q/N384S/K392N/V397M/Q419E/K447_ |
| pI_ISO(-)-Fc only | K274Q/R355Q/N384S/K392N/V397M/Q419E/K447_ |
| pI_(-)_isosteric A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 5

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 6A

| IL-15-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6B

| scIL-15/Rα-Fc monomer (-) | empty-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6C

| empty-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6D

| IL-15Rα(sushi)-Fc Chain 1 | IL-15Rα(sushi)-Fc Chain 2 |
|---|---|
| C220S | C220S |
| FcKO E233P/L234V/L235A/G236_/S267K | FcKO E233P/L234V/L235A/G236_/S267K |
| ±M428L/N434S | ±M428L/N434S |

Figure 6E

| Fc-IL-15Rα(sushi) (-) | IL-15Rα(sushi)-Fc monomer (+) |
|---|---|
| C220S | C220S |
| Heterodimer pI variants L368D/K370S | Heterodimer pI variants S364K/E357Q |
|  | Isosteric pI substitutions P217R/P228R/N276K |
| FcKO E233P/L234V/L235A/G236_/S267K | FcKO E233P/L234V/L235A/G236_/S267K |
| ±M428L/N434S | ±M428L/N434S |

Figure 7A

| scIL-15/Rα-Fc monomer (-) | scFv-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7B

| scFv-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7C

| scIL-15/Rα-Fc monomer (-) | Heavy Chain (+) |
|---|---|
| C220S | |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7D

| Heavy Chain (-) | IL-15Rα(sushi)-Fc monomer (+) |
|---|---|
| | C220S |
| Heterodimer pI variants L368D/K370S | Heterodimer pI variants S364K/E357Q |
| Isosteric pI substitutions N208D/Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7E

| Heavy Chain-IL-15Rα(sushi) (-) | Heavy Chain (+) |
|---|---|
| Heterodimer pI variants L368D/K370S | Heterodimer pI variants S364K/E357Q |
| Isosteric pI substitutions<br>N208D/Q295E/N384D/Q418E/N421D | Isosteric pI subsitutions<br>Q196K/I199T/P217R/P228R/N276K |
| FcKO<br>E233P/L234V/L235A/G236_/S267K | FcKO<br>E233P/L234V/L235A/G236_/S267K |
| ±M428L/N434S | ±M428L/N434S |

Figure 7F

| Heavy Chain (-) | Heavy Chain-IL-15Rα(sushi) (+) |
|---|---|
| Heterodimer pI variants L368D/K370S | Heterodimer pI variants S364K/E357Q |
| Isosteric pI substitutions<br>N208D/Q295E/N384D/Q418E/N421D | Isosteric pI subsitutions<br>Q196K/I199T/P217R/P228R/N276K |
| FcKO<br>E233P/L234V/L235A/G236_/S267K | FcKO<br>E233P/L234V/L235A/G236_/S267K |
| ±M428L/N434S | ±M428L/N434S |

Figure 8

| Name | Sequence | SEQ ID NO: |
|---|---|---|
| (GGGGS)₁ or GGGGS | GGGGS | 10 |
| (GGGGS)₂ | GGGGSGGGGS | 21 |
| (GGGGS)₃ | GGGGSGGGGSGGGGS | 22 |
| (GGGGS)₄ | GGGGSGGGGSGGGGSGGGGS | 23 |
| (GGGGS)₅ | GGGGSGGGGSGGGGSGGGGSGGGGS | 24 |
| (GGGGS)₆ | GGGGSGGGGSGGGGSGGGGSGGGGSGGGGS | 25 |
| (GGGGS)₇ | GGGGSGGGGSGGGGSGGGGSGGGGSGGGGSGGGGS | 26 |
| 30AA-linker | DPALVHQRPAPPGGGGSGGGGSGGGGSGGG | 27 |
| (GKPGS)₁ or GKPGS | GKPGS | 28 |
| (GKPGS)₅ | GKPGSGKPGSGKPGSGKPGSGKPGS | 29 |
| (GKPGS)₆ | GKPGSGKPGSGKPGSGKPGSGKPGSGKPGS | 30 |
| (GGGES)₁ or GGGES | GGGES | 31 |

Figure 9A

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 22 |
| Whitlow linker | GSTSGSGKPGSGEGSTKG | 18 | +1 | 32 |
| 6paxA_1 (+A) | IRPRAIGGSKPRVA | 14 | +4 | 33 |
| +B | GKGGSGKGGSGKGGS | 15 | +3 | 34 |
| +C | GGKGSGGKGSGGKGS | 15 | +3 | 35 |
| +D | GGGKSGGGKSGGGKS | 15 | +3 | 36 |
| +E | GKGKSGKGKSGKGKS | 15 | +6 | 37 |
| +F | GGGKSGGKGSGKGGS | 15 | +3 | 38 |
| +G | GKPGSGKPGSGKPGS | 15 | +3 | 39 |
| +H | GKPGSGKPGSGKPGSGKPGS | 20 | +4 | 40 |
| +I | GKGKSGKGKSGKGKSGKGKS | 20 | +8 | 41 |

Figure 9B

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 23 |
| 3hsc_2 (-A) | STAGDTHLGGEDFD | 14 | -4 | 42 |
| -B | GEGGSGEGGSGEGGS | 15 | -3 | 43 |
| -C | GGEGSGGEGSGGEGS | 15 | -3 | 44 |
| -D | GGGESGGGESGGGES | 15 | -3 | 45 |
| -E | GEGESGEGESGEGES | 15 | -6 | 46 |
| -F | GGGESGGEGSGEGGS | 15 | -3 | 47 |
| -G | GEGESGEGESGEGESGEGES | 20 | -8 | 48 |

Figure 9C

Additional scFv Linkers

| Sequence | SEQ ID NO: |
|---|---|
| GGGGSGGGGSGGGGS | SEQ ID NO:22 |
| GGGGSGGGGSGGGGSGGGGS | SEQ ID NO:23 |
| GSTSGSGKPGSGEGSTKG | SEQ ID NO:32 |
| PRGASKSGSASQTGSAPGS | SEQ ID NO:49 |
| GTAAAGAGAAGGAAAGAAG | SEQ ID NO:50 |
| GTSGSSGSGSGGSGSGGGG | SEQ ID NO:51 |
| GKPGSGKPGSGKPGSGKPGS | SEQ ID NO:40 |

Figure 10A

IL-15/Rα-Fc Backbone 1

>IL-15/Rα-Fc monomer 1 (SEQ ID NO: 52)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >IL-15/Rα-Fc monomer 2 (SEQ ID NO: 53)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

IL-15/Rα-Fc Backbone 2

>IL-15/Rα-Fc monomer 1 (SEQ ID NO: 54)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK >IL-15/Rα-Fc monomer 2 (SEQ ID NO: 55)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

IL-15/Rα-Fc Backbone 3

>IL-15/Rα-Fc monomer 1 (SEQ ID NO: 56)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVKLTCLVK
GFYPSDIAVEWESNGQPENNYKTTPPVLDSDGSFFLYSKLTVDKSRWQQGNVFSCSVMHEALHNHYTQKSLSLSPGK >IL-15/Rα-Fc monomer 2 (SEQ ID NO: 57)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCEVS
GFYPSDIAVEWESDGQPENNYKTTPPVLDSDGSFFLYSKLTVDKSRWEQGDVFSCSVMHEALHNHYTQKSLSLSPGK

IL-15/Rα-Fc Backbone 4

>IL-15/Rα-Fc monomer 1 (SEQ ID NO: 58)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSKGSFFLYSKLTVDKSRWQQGNVFSCSVMHEALHNHYTQKSLSLSPGK >IL-15/Rα-Fc monomer 2 (SEQ ID NO: 59)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTENEVSLTCLVK
GFYPSDIAVEWESDGQPENNYKTTPPVLDSDGSFFLYSKLEVDKSRWEQGDVFSCSVMHEALHNHYTQKSLSLSPGK

Figure10B

IL-15/Rα-Fc Backbone 5

>IL-15/Rα-Fc monomer 1 (SEQ ID NO: 60)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSRDQLTKNQVKLTCLVK
GFYPSDIAVEWESNGQPENNYKTTPPVLDSDGSFFLYSKLTVDKSRWQQGNVFSCSVMHEALHNHYTQKSLSLSPGK

>IL-15/Rα-Fc monomer 2 (SEQ ID NO: 61)
EPKSSDKTHTCPPCPAPPVAGPSVFLFPPKPKDTLMISRTPEVTCVVVDVKHEDPEVKFNWYVDGVEVHNAKTKPRE
EYNSTYRVVSVLTVLHQDWLNGKEYKCKVSNKALPAPIEKTISKAKGQPREPQVYTLPPSRDELTKNQVSLTCDVS
GFYPSDIAVEWESDGQPENNYKTTPPVLDSDGSFFLYSKLTVDKSRWEQGDVFSCSVMHEALHNHYTQKSLSLSPGK

IL-15/Rα-Fc Backbone 6

>IL-15/Rα-Fc monomer 1 (SEQ ID NO: 62)
EPKSSDKTHTCPPCPAPPVAGPSVFLFPPKPKDTLMISRTPEVTCVVVDVKHEDPEVKFNWYVDGVEVHNAKTKPRE
EQYASTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>IL-15/Rα-Fc monomer 2 (SEQ ID NO: 63)
EPKSSDKTHTCPPCPAPPVAGPSVFLFPPKPKDTLMISRTPEVTCVVVDVKHEDPEVKFNWYVDGVEVHNAKTKPRE
EEYASTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

IL-15/Rα-Fc Backbone 7

>IL-15/Rα-Fc monomer 1 (SEQ ID NO: 64)
EPKSSDKTHTCPPCPAPPVAGPSVFLFPPKPKDTLMISRTPEVTCVVVDVKHEDPEVKFNWYVDGVEVHNAKTKPRE
EQYSSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>IL-15/Rα-Fc monomer 2 (SEQ ID NO: 65)
EPKSSDKTHTCPPCPAPPVAGPSVFLFPPKPKDTLMISRTPEVTCVVVDVKHEDPEVKFNWYVDGVEVHNAKTKPRE
EEYSSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

IL-15/Rα-Fc Backbone 8

>IL-15/Rα-Fc monomer 1 (SEQ ID NO: 66)
ESKYGPPCPPCPAPEFLGGPSVFLFPPKPKDTLMISRTPEVTCVVVDVSQEDPEVQFNWYVDGVEVHNAKTKPREEQ
FNSTYRVVSVLTVLHQDWLNGKEYKCKVSNKGLPSSIEKTISKAKGQPREPQVYTLPPSQEQMTKNQVKLTCLVKGF
YPSDIAVEWESNGQPENNYKTTPPVLDSDGSFFLYSRLTVDKSRWQEGNVFSCSVMHEALHNHYTQKSLSLSLGK

>IL-15/Rα-Fc monomer 2 (SEQ ID NO: 67)
ESKYGPPCPPCPAPEFLGGPSVFLFPPKPKDTLMISRTPEVTCVVVDVSQEDPEVQFNWYVDGVEVHNAKTKPREEE
FNSTYRVVSVLTVLHQDWLNGKEYKCKVSNKGLPSSIEKTISKAKGQPREPQVYTLPPSQEEMTKNQVSLTCDVSGF
YPSDIAVEWESDGQPENNYKTTPPVLDSDGSFFLYSRLTVDKSRWEEGDVFSCSVMHEALHNHYTQKSLSLSLGK

Figure10C

IL-15/Rα-Fc Backbone 9

>IL-15/Rα-Fc monomer 1 (SEQ ID NO: 68)
ERKCCVECPPCPAPPVAGPSVFLFPPKPKDTLMISRTPEVTCVVVDVSHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK >IL-15/Rα-Fc monomer 2 (SEQ ID NO: 69)
ERKCCVECPPCPAPPVAGPSVFLFPPKPKDTLMISRTPEVTCVVVDVSHEDPEVQFNWYVDGVEVHNAKTKPREEEF
NSTFRVVSVLTVVHQDWLNGKEYKCKVSNKGLPAPIEKTISKTKGQPREPQVYTLPPSREEMTKNQVSLTCDVSGFY
PSDIAVEWESDGQPENNYKTTPPMLDSDGSFFLYSKLTVDKSRWEQGDVFSCSVMHEALHNHYTQKSLSLSPGK

IL-15/Rα-Fc Backbone 10

>IL-15/Rα-Fc monomer 1 (SEQ ID NO: 70)
ERKCCVECPPCPAPPVAGPSVFLFPPKPKDTLMISRTPEVTCVVVDVKHEDPEVQFNWYVDGVEVHNAKTKPREEQF
NSTFRVVSVLTVVHQDWLNGKEYKCKVSNKGLPAPIEKTISKTKGQPREPQVYTLPPSREQMTKNQVKLTCLVKGFY
PSDIAVEWESNGQPENNYKTTPPMLDSDGSFFLYSKLTVDKSRWQQGNVFSCSVMHEALHNHYTQKSLSLSPGK >IL-15/Rα-Fc monomer 2 (SEQ ID NO: 71)
ERKCCVECPPCPAPPVAGPSVFLFPPKPKDTLMISRTPEVTCVVVDVKHEDPEVQFNWYVDGVEVHNAKTKPREEEF
NSTFRVVSVLTVVHQDWLNGKEYKCKVSNKGLPAPIEKTISKTKGQPREPQVYTLPPSREEMTKNQVSLTCDVSGFY
PSDIAVEWESDGQPENNYKTTPPMLDSDGSFFLYSKLTVDKSRWEQGDVFSCSVMHEALHNHYTQKSLSLSPGK

IL-15/Rα-Fc Backbone 11

>IL-15/Rα-Fc monomer 1 (SEQ ID NO: 72)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSPGK >IL-15/Rα-Fc monomer 2 (SEQ ID NO: 73)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVLHEALHSHYTQKSLSLSPGK

IL-15/Rα-Fc Backbone 12

>IL-15/Rα-Fc monomer 1 (SEQ ID NO: 74)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPGK >IL-15/Rα-Fc monomer 2 (SEQ ID NO: 75)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREEMTKNQVSLTCLVK
GFYPSDIAVEWESNGQPENNYKTTPPVLDSDGSFFLYSKLTVDKSRWQQGNVFSCSVMHEALHNHYTQKSLSLSPGK

Figure10D

IL-15/Rα-Fc Backbone 13

>IL-15/Rα-Fc monomer 1 (SEQ ID NO: 76)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

>IL-15/Rα-Fc monomer 2 (SEQ ID NO: 77)
ERKSSDKTHTCPRCPAPPVAGPSVFLFPPKPKDTLMISRTPEVTCVVVDVKHEDPEVKFKWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 11

IL-15/Rα x anti-PD-1 Backbone 1

>Chain 1 (SEQ ID NO: 78)
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTK
VDKKVEPKSCDKTHTCPPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVMHEALHNHYTQKSLSLSPGK >Chain 2 (SEQ ID NO: 79)
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESDGQPENNYKTTPPVLDSDG
SFFLYSKLTVDKSRWEQGDVFSCSVMHEALHNHYTQKSLSLSPGK

IL-15/Rα x anti-PD-1 Backbone 2

>Chain 1 (SEQ ID NO: 80)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTK
VDKKVEPKSCDKTHTCPPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEWESDGQPENNYKTTPPV
LDSDGSFFLYSKLTVDKSRWEQGDVFSCSVMHEALHNHYTQKSLSLSPGK >Chain 2 (SEQ ID NO: 81)
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVL
HQDWLNGKEYKCKVSNKALPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK

IL-15/Rα x anti-PD-1 Backbone 3

>Chain 1 (SEQ ID NO: 82)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTK
VDKKVEPKSCDKTHTCPPCPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAVEWESDGQPENNYKTTPPV
LDSDGSFFLYSKLTVDKSRWEQGDVFSCSVMHEALHNHYTQKSLSLSPGK >Chain 2 (SEQ ID NO: 83)
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTK
VDKKVERKSCDKTHTCPRCPAPPVAGPSVFLFPPKPKDTLMISRTPEVTCVVVDVKHEDPEVKFKWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEWESNGQPENNYKTTPPV
LDSDGSFFLYSKLTVDKSRWQQGNVFSCSVMHEALHNHYTQKSLSLSPGK

Figure 12

Constant Light Chain – Kappa (SEQ ID NO: 84)
RTVAAPSVFIFPPSDEQLKSGTASVVCLLNNFYPREAKVQWKVDNALQSGNSQESVTEQDSKDSTYSLSSTLTLSKADYEKHKVYACEVTHQG
LSSPVTKSFNRGEC

Constant Light Chain – Lambda (SEQ ID NO: 85)
GQPKAAPSVTLFPPSSEELQANKATLVCLISDFYPGAVTVAWKADSSPVKAGVETTTPSKQSNNKYAASSYLSLTPE
QWKSHRSYSCQVTHEGSTVEKTVAPTECS

A)

IL-15/Rα-heteroFc

B)

scIL-15/Rα-Fc

C)

ncIL-15/Rα-Fc

D)

Bivalent ncIL-15/Rα-Fc

Bivalent scIL-15/Rα-Fc

Fc-ncIL-15/Rα

Fc-scIL-15/Rα

Figure 14

>XENP20818 – human IL15-(GGGGS)₁ x human IL15Rα(Sushi)-(GGGGS)₁ Fc heterodimer (SEQ ID NO: 86)

Chain 1 - human_IL15_(GGGGS)₁_Fc(216)_IgG1_pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVMHEALHNHYTQKSLSLSPGK

Chain 2 - human_IL15Rα(Sushi)_(GGGGS)₁_Fc(216)_IgG1_C220S/PVA_/S267K/S364K/E357Q (SEQ ID NO: 87)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

>XENP22853 human_IL15_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S

XENP22853 Chain 1 - human_IL15_(GGGGS)1-Fc(216)_IgG1_pI(-)_Isosteric_A_C220S/PVA_/S267K/L368D/K370S/M428L/N434S (SEQ ID NO: 88)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVLHEALHSHYTQKSLSLSPGK

XENP22853 Chain 2 - human_IL15Ra(Sushi)_(GGGGS)1-Fc(216)_IgG1_C220S/PVA_/S267K/S364K/E357Q/M428L/N434S (SEQ ID NO: 89)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Figure 15

>XENP21478 – human IL15Rα(Sushi)-(GGGGS)₆-human IL15(single-chain) Fc heterodimer

Chain 1 - human_IL15Rα(sushi)_(GGGGS)₆-human_IL15-Fc(216)_IgG1_pI(-)_Isosteric_A_C220S/PVA_/S267K/L368D/K370S (16478) (SEQ ID NO: 90)

ITCPPPMSVEHADIWVKSYSLYSRERYICNSGFKRKAGTSSLTECVLNKATNVAHWTTPSLKCIR/GGGGSGGGGSG
GGGSGGGGSGGGGSGGGGS/NWVNVISDLKKIEDLIQSMHIDATLYTESDVHPSCKVTAMKCFLLELQVISLESGDA
SIHDTVENLIILANNSLSSNGNVTESGCKECEELEEKNIKEFLQSFVHIVQMFINTS/EPKSSDKTHTCPPCPAPPV
AGPSVFLFPPKPKDTLMISRTPEVTCVVVDVKHEDPEVKFNWYVDGVEVHNAKTKPREEEYNSTYRVVSVLTVLHQD
WLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

Chain 2 - empty-Fc(216)_IgG1_C220S/PVA_/S267K/S364K/E357Q (8924) (SEQ ID NO: 91)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP021993 human_IL15Ra(sushi)_(GGGGS)5-human_IL15(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(single-chain)_Fc(216)_IgG1_pI(-)_Isosteric_A_C220S/PVA_/S267K/L368D/K370S (SEQ ID NO: 92)

ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESDVHPSCKVTAMKCFLLELQVISLESGDASIHDT
VENLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q (SEQ ID NO: 93)

EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 16

>XENP21479 – empty-Fc-IL15(non-covalent)-human_IL15Rα(Sushi) Fc heterodimer

Chain 1 - human_IL15_no_tag (16484) (SEQ ID NO: 94)
NWVNVISDLKKIEDLIQSMHIDATLYTESDVHPSCKVTAMKCFLLELQVISLESGDASIHDTVENLIILANNSLSSN
GNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) (SEQ ID NO: 95)
EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVS
GFYPSDIAVEWESDGQPENNYKTTPPVLDSDGSFFLYSKLTVDKSRWEQGDVFSCSVMHEALHNHYTQKSLSLSPGK

Chain 3 - human_IL15Rα(Sushi)-Fc(216)_IgG1_C220S/PVA_/S267K/S364K/E357Q (16481) (SEQ ID NO: 96)
ITCPPPMSVEHADIWVKSYSLYSRERYICNSGFKRKAGTSSLTECVLNKATNVAHWTTPSLKCIR/EPKSSDKTHTC
PPCPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREQMTKNQVKLTCLVKGFYPSDIAVEW
ESNGQPENNYKTTPPVLDSDGSFFLYSKLTVDKSRWQQGNVFSCSVMHEALHNHYTQKSLSLSPGK

Figure 19A

N1D (SEQ ID NO: 97)
DWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS

N4D (SEQ ID NO: 98)
NWVDVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS

D8N (SEQ ID NO: 99)
NWVNVISNLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS

D30N (SEQ ID NO: 100)
NWVNVISDLKKIEDLIQSMHIDATLYTESNVHPSCKVTAMKCFLLELQVISLESGDASIHDTVENLIILANNSLSSNGNVTES
GCKECEELEEKNIKEFLQSFVHIVQMFINTS

D61N (SEQ ID NO: 101)
NWVNVISDLKKIEDLIQSMHIDATLYTESDVHPSCKVTAMKCFLLELQVISLESGDASIHNTVENLIILANNSLSSNGNVTES
GCKECEELEEKNIKEFLQSFVHIVQMFINTS

E64Q (SEQ ID NO: 102)
NWVNVISDLKKIEDLIQSMHIDATLYTESDVHPSCKVTAMKCFLLELQVISLESGDASIHDTVQNLIILANNSLSSNGNVTES
GCKECEELEEKNIKEFLQSFVHIVQMFINTS

N65D (SEQ ID NO: 103)
NWVNVISDLKKIEDLIQSMHIDATLYTESDVHPSCKVTAMKCFLLELQVISLESGDASIHDTVEDLIILANNSLSSNGNVTES
GCKECEELEEKNIKEFLQSFVHIVQMFINTS

Q108E (SEQ ID NO: 104)
NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVEMFINTS

N1D/D61N (SEQ ID NO: 105)
DWVNVISDLKKIEDLIQSMHIDATLYTESDVHPSCKVTAMKCFLLELQVISLESGDASIHNTVENLIILANNSLSSNGNVTES
GCKECEELEEKNIKEFLQSFVHIVQMFINTS

N1D/E64Q (SEQ ID NO: 106)
DWVNVISDLKKIEDLIQSMHIDATLYTESDVHPSCKVTAMKCFLLELQVISLESGDASIHDTVQNLIILANNSLSSNGNVTES
GCKECEELEEKNIKEFLQSFVHIVQMFINTS

N4D/D61N (SEQ ID NO: 107)
NWVDVISDLKKIEDLIQSMHIDATLYTESDVHPSCKVTAMKCFLLELQVISLESGDASIHNTVENLIILANNSLSSNGNVTES
GCKECEELEEKNIKEFLQSFVHIVQMFINTS

N4D/E64Q (SEQ ID NO: 108)
NWVDVISDLKKIEDLIQSMHIDATLYTESDVHPSCKVTAMKCFLLELQVISLESGDASIHDTVQNLIILANNSLSSNGNVTES
GCKECEELEEKNIKEFLQSFVHIVQMFINTS

Figure 19B

D8N/D61N (SEQ ID NO: 109)
NWVNVISNLKKIEDLIQSMHIDATLYTESDVHPSCKVTAMKCFLLELQVISLESGDASIHNTVENLIILANNSLSSNGNVTES
GCKECEELEEKNIKEFLQSFVHIVQMFINTS

D8N/E64Q (SEQ ID NO: 110)
NWVNVISNLKKIEDLIQSMHIDATLYTESDVHPSCKVTAMKCFLLELQVISLESGDASIHDTVQNLIILANNSLSSNGNVTES
GCKECEELEEKNIKEFLQSFVHIVQMFINTS

D61N/E64Q (SEQ ID NO: 111)
NWVNVISDLKKIEDLIQSMHIDATLYTESDVHPSCKVTAMKCFLLELQVISLESGDASIHNTVQNLIILANNSLSSNGNVTES
GCKECEELEEKNIKEFLQSFVHIVQMFINTS

E64Q/Q108E (SEQ ID NO: 112)
NWVNVISDLKKIEDLIQSMHIDATLYTESDVHPSCKVTAMKCFLLELQVISLESGDASIHDTVQNLIILANNSLSSNGNVTES
GCKECEELEEKNIKEFLQSFVHIVEMFINTS

N1D/N4D/D8N (SEQ ID NO: 113)
DWVDVISNLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS

D61N/E64Q/N65D (SEQ ID NO: 114)
NWVNVISDLKKIEDLIQSMHIDATLYTESDVHPSCKVTAMKCFLLELQVISLESGDASIHNTVQDLIILANNSLSSNGNVTES
GCKECEELEEKNIKEFLQSFVHIVQMFINTS

N1D/D61N/E64Q/Q108E (SEQ ID NO: 115)
DWVNVISDLKKIEDLIQSMHIDATLYTESDVHPSCKVTAMKCFLLELQVISLESGDASIHNTVQNLIILANNSLSSNGNVTES
GCKECEELEEKNIKEFLQSFVHIVEMFINTS

N4D/D61N/E64Q/Q108E (SEQ ID NO: 116)
NWVDVISDLKKIEDLIQSMHIDATLYTESDVHPSCKVTAMKCFLLELQVISLESGDASIHNTVQNLIILANNSLSSNGNVTES
GCKECEELEEKNIKEFLQSFVHIVEMFINTS

N1D/N65D (SEQ ID NO: 117)
DWVNVISDLKKIEDLIQSMHIDATLYTESDVHPSCKVTAMKCFLLELQVISLESGDASIHDTVEDLIILANNSLSSNGNVTES
GCKECEELEEKNIKEFLQSFVHIVQMFINTS

N1D/Q108E (SEQ ID NO: 118)
DWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVEMFINTS

N4D/N65D (SEQ ID NO: 119)
NWVDVISDLKKIEDLIQSMHIDATLYTESDVHPSCKVTAMKCFLLELQVISLESGDASIHDTVEDLIILANNSLSSNGNVTES
GCKECEELEEKNIKEFLQSFVHIVQMFINTS

N1D/D30N (SEQ ID NO: 120)
DWVNVISDLKKIEDLIQSMHIDATLYTESNVHPSCKVTAMKCFLLELQVISLESGDASIHDTVENLIILA
NNSLSSNGNVTESGCKECEELEEKNIKEFLQSFVHIVQMFINTS

Figure 19C

N4D/D30N (SEQ ID NO: 121)
NWVDVISDLKKIEDLIQSMHIDATLYTESNVHPSCKVTAMKCFLLELQVISLESGDASIHDTVENLIILA
NNSLSSNGNVTESGCKECEELEEKNIKEFLQSFVHIVQMFINTS

D30N/E64Q (SEQ ID NO: 122)
NWVNVISDLKKIEDLIQSMHIDATLYTESNVHPSCKVTAMKCFLLELQVISLESGDASIHDTVQNLIILA
NNSLSSNGNVTESGCKECEELEEKNIKEFLQSFVHIVQMFINTS

D30N/N65D (SEQ ID NO: 123)
NWVNVISDLKKIEDLIQSMHIDATLYTESNVHPSCKVTAMKCFLLELQVISLESGDASIHDTVEDLIILANNSLSSNGNVTES
GCKECEELEEKNIKEFLQSFVHIVQMFINTS

D30N/Q108E (SEQ ID NO: 124)
NWVNVISDLKKIEDLIQSMHIDATLYTESNVHPSCKVTAMKCFLLELQVISLESGDASIHDTVENLIILANNSLSSNGNVTES
GCKECEELEEKNIKEFLQSFVHIVEMFINTS

N65D/Q108E (SEQ ID NO: 125)
NWVNVISDLKKIEDLIQSMHIDATLYTESDVHPSCKVTAMKCFLLELQVISLESGDASIHDTVEDLIILANNSLSSNGNVTES
GCKECEELEEKNIKEFLQSFVHIVEMFINTS

E64Q/N65D (SEQ ID NO: 126)
NWVNVISDLKKIEDLIQSMHIDATLYTESDVHPSCKVTAMKCFLLELQVISLESGDASIHDTVQDLIILANNSLSSNGNVTES
GCKECEELEEKNIKEFLQSFVHIVQMFINTS

N1D/N4D/N65D (SEQ ID NO: 127)
DWVDVISDLKKIEDLIQSMHIDATLYTESDVHPSCKVTAMKCFLLELQVISLESGDASIHDTVEDLIILANNSLSSNGNVTES
GCKECEELEEKNIKEFLQSFVHIVQMFINTS

D30N/E64Q/N65D (SEQ ID NO: 128)
NWVNVISDLKKIEDLIQSMHIDATLYTESNVHPSCKVTAMKCFLLELQVISLESGDASIHDTVQDLIILANNSLSSNGNVTES
GCKECEELEEKNIKEFLQSFVHIVQMFINTS

N4D/D61N/N65D (SEQ ID NO: 129)
NWVDVISDLKKIEDLIQSMHIDATLYTESDVHPSCKVTAMKCFLLELQVISLESGDASIHNTVEDLIILANNSLSSNGNVTES
GCKECEELEEKNIKEFLQSFVHIVQMFINTS

Figure 20

>XENP24113 human_IL15_N4D/N65D_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S XENP24113 Chain 1 - human_IL15_N4D/N65D_(GGGGS)1-Fc(216)_IgG1_pI(-)_Isosteric_A_C220S/PVA_/S267K/L368D/K370S/M428L/N434S (SEQ ID NO: 130)
NWVDVISDLKKIEDLIQSMHIDATLYTESDVHPSCKVTAMKCFLLELQVISLESGDASIHDTVEDLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVLHEALHSHYTQKSLSLSPGK XENP24113 Chain 2 - human_IL15Ra(Sushi)_(GGGGS)1-Fc(216)_IgG1_C220S/PVA_/S267K/S364K/E357Q/M428L/N434S (SEQ ID NO: 131)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK >XENP24306 human_IL15_D30N/E64Q/N65D_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S XENP24306 Chain 1 - human_IL15_D30N/E64Q/N65D_(GGGGS)1-Fc(216)_IgG1_pI(-)_Isosteric_A_C220S/PVA_/S267K/L368D/K370S/M428L/N434S (SEQ ID NO: 132)
NWVNVISDLKKIEDLIQSMHIDATLYTESNVHPSCKVTAMKCFLLELQVISLESGDASIHDTVQDLIILANNSLSSN
GNVTESGCKECEELEEKNIKEFLQSFVHIVQMFINTS/GGGGS/EPKSSDKTHTCPPCPAPPVAGPSVFLFPPKPKD
TLMISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSDGS
FFLYSKLTVDKSRWEQGDVFSCSVLHEALHSHYTQKSLSLSPGK XENP24306 Chain 2 - human_IL15Ra(Sushi)_(GGGGS)1-Fc(216)_IgG1_C220S/PVA_/S267K/S364K/E357Q/M428L/N434S (SEQ ID NO: 133)
ITCPPPMSVEHADIWVKSYSLYSRERYICNSGFKRKAGTSSLTECVLNKATNVAHWTTPSLKCIR/GGGGS/EPKSS
DKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Figure 21A

>XENP29281 human_IL15Ra(sushi)_(GGGGS)5-human_IL15_D30N_(single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

XENP29281 Chain 1 - human_IL15Ra(sushi)_(GGGGS)5-human_IL15_D30N_(single-Chain)-Fc(216)_IgG1_pI(-)_Isosteric_A_C220S/PVA_/S267K/L368D/K370S (SEQ ID NO: 134)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESNVHPSCKVTAMKCFLLELQVISLESGDASIHDT
VENLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

XENP29281 Chain 2 - empty-Fc(216)_IgG1_C220S/PVA_/S267K/S364K/E357Q (SEQ ID NO: 135)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP24050 human_IL15Ra(sushi)_(GGGGS)5-human_IL15_N4D/N65D_(single-Chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

XENP24050 Chain 1 - human_IL15Ra(sushi)_(GGGGS)5-human_IL15_N4D/N65D_(single-Chain)-Fc(216)_IgG1_pI(-)_Isosteric_A_C220S/PVA_/S267K/L368D/K370S (SEQ ID NO: 136)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

XENP24050 Chain 2 - empty-Fc(216)_IgG1_C220S/PVA_/S267K/S364K/E357Q (SEQ ID NO: 137)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

>XENP24294 human_IL15Ra(sushi)_(GGGGS)5-human_IL15_N4D/N65D_(single-Chain)-empty-Fc_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S

XENP24294 Chain 1 - human_IL15Ra(sushi)_(GGGGS)5-human_IL15_N4D/N65D_(single-Chain)-Fc(216)_IgG1_pI(-)_Isosteric_A_C220S/PVA_/S267K/L368D/K370S/M428L/N434S (SEQ ID NO: 138)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVLHEALHSHYTQKSLSLSPGK

XENP24294 Chain 2 - empty-Fc(216)_IgG1_C220S/PVA_/S267K/S364K/E357Q/M428L/N434S (SEQ ID NO: 139)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVLHEALHSHYTQKSLSLSPGK

Figure 21B

>XENP29285 human_IL15Ra(sushi)_(GGGGS)5-human_IL15_D30N/N65D_(single-Chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q XENP29285 Chain 1 - human_IL15Ra(sushi)_(GGGGS)5-human_IL15_D30N/N65D_(single-Chain)-
Fc(216)_IgG1_pI(-)_Isosteric_A_C220S/PVA_/S267K/L368D/K370S (SEQ ID NO: 140)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESNVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK XENP29285 Chain 2 - empty-Fc(216)_IgG1_C220S/PVA_/S267K/S364K/E357Q (SEQ ID NO: 141)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK >XENP29286 human_IL15Ra(sushi)_(GGGGS)5-human_IL15_D30N/E64Q/N65D_(single-Chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q XENP29286 Chain 1 - human_IL15Ra(sushi)_(GGGGS)5-human_IL15_D30N/E64Q/N65D_(single-Chain)-
Fc(216)_IgG1_pI(-)_Isosteric_A_C220S/PVA_/S267K/L368D/K370S (SEQ ID NO: 142)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESNVHPSCKVTAMKCFLLELQVISLESGDASIHDT
VQDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK XENP29286 Chain 2 - empty-Fc(216)_IgG1_pI(-)_Isosteric_A_C220S/PVA_/S267K/L368D/K370S (SEQ ID NO: 143)
EPKSSDKTHTCPPCPAPPVAGPSVFLFPPKPKDTLMISRTPEVTCVVVDVKHEDPEVKFNWYVDGVEVHNAKTKPRE
EQYNSTYRVVSVLTVLHQDWLNGKEYKCKVSNKALPAPIEKTISKAKGQPREPQVYTLPPSREQMTKNQVKLTCLVK
GFYPSDIAVEWESNGQPENNYKTTPPVLDSDGSFFLYSKLTVDKSRWQQGNVFSCSVMHEALHNHYTQKSLSLSPGK

Figure 23

>XENP015074 Numax IgG1 PVA /S267K

*XENP015074 Numax_IgG1_PVA_/S267K Heavy Chain* (SEQ ID NO: 144)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK

*XENP015074 Numax_IgG1_PVA_/S267K Light Chain* (SEQ ID NO: 145)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 24

A) XENP016432 Nivolumab_H0L0_IgG1_PVA_/S267K

XENP016432 Nivolumab_H0L0_IgG1_PVA_/S267K Heavy Chain (SEQ ID NO: 146)
QVQLVESGGGVVQPGRSLRLDCKASGITFSNSGMHWVRQAPGKGLEWVAVIWYDGSKRYYADSVKGRFTISRDNSKN
TLFLQMNSLRAEDTAVYYCATNDDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQD
WLNGKEYKCKVSNKALPAPIEKTISKAKGQPREPQVYTLPPSREEMTKNQVSLTCLVKGFYPSDIAVEWESNGQPEN
NYKTTPPVLDSDGSFFLYSKLTVDKSRWQQGNVFSCSVMHEALHNHYTQKSLSLSPGK XENP016432 Nivolumab_H0L0_IgG1_PVA_/S267K Light Chain (SEQ ID NO: 147)
EIVLTQSPATLSLSPGERATLSCRASQSVSSYLAWYQQKPGQAPRLLIYDASNRATGIPARFSGSGSGTDFTLTISS
LEPEDFAVYYCQQSSNWPRTFGQGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

B) XENP021461 Pembrolizumab_H0L0_IgG4_S228P

XENP021461 Pembrolizumab_H0L0_IgG4_S228P Heavy Chain (SEQ ID NO: 148)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS/ASTKGPSVFPLAPCSRSTSESTAALGCLVKDYF
PEPVTVSWNSGALTSGVHTFPAVLQSSGLYSLSSVVTVPSSSLGTKTYTCNVDHKPSNTKVDKRVESKYGPPCPPCP
APEFLGGPSVFLFPPKPKDTLMISRTPEVTCVVVDVSQEDPEVQFNWYVDGVEVHNAKTKPREEQFNSTYRVVSVLT
VLHQDWLNGKEYKCKVSNKGLPSSIEKTISKAKGQPREPQVYTLPPSQEEMTKNQVSLTCLVKGFYPSDIAVEWESN
GQPENNYKTTPPVLDSDGSFFLYSRLTVDKSRWQEGNVFSCSVMHEALHNHYTQKSLSLSLGK XENP021461 Pembrolizumab_H0L0_IgG4_S228P Light Chain (SEQ ID NO: 149)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

C) XENP28437 Pembrolizumab_H0L0_IgG1_PVA_/S267K

XENP28437 Chain 1 - Pembrolizumab_H0_IgG1_PVA_/S267K Heavy Chain (SEQ ID NO: 150)
QVQLVQSGVEVKKPGASVKVSCKASGYTFTNYYMYWVRQAPGQGLEWMGGINPSNGGTNFNEKFKNRVTLTTDSSTT
TAYMELKSLQFDDTAVYYCARRDYRFDMGFDYWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREEMTKNQVSLTCLVKGFYPSDIAVEWE
SNGQPENNYKTTPPVLDSDGSFFLYSKLTVDKSRWQQGNVFSCSVMHEALHNHYTQKSLSLSPGK XENP28437 Chain 2 - Pembrolizumab_L0 Light Chain (SEQ ID NO: 151)
EIVLTQSPATLSLSPGERATLSCRASKGVSTSGYSYLHWYQQKPGQAPRLLIYLASYLESGVPARFSGSGSGTDFTL
TISSLEPEDFAVYYCQHSRDLPLTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 25

>XENP021575 1C11[PD-1]_H0L0_IgG1_PVA_/S267K Heavy Chain (SEQ ID NO: 152)
QIQLVQSGPELKKPGETVKISCRASGYTFTHYGMNWVKQAPGKGLKWMGWINTYTGEPTYADDFKGRFAFSLETSASTAYLQINNLKNEDTAT
YFCARDYYGSSPYWGQGTTLTVSS/ASTKGPSVFPLAPSSKSTSGGTAALGCLVKDYFPEPVTVSWNSGALTSGVHTFPAVLQSSGLYSLSSV
VTVPSSSLGTQTYICNVNHKPSNTKVDKKVEPKSCDKTHTCPPCPAPPVAGPSVFLFPPKPKDTLMISRTPEVTCVVVDVKHEDPEVKFNWYV
DGVEVHNAKTKPREEQYNSTYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

>XENP021575 1C11[PD-1]_H0L0_IgG1_PVA_/S267K Light Chain (SEQ ID NO: 153)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYC
FQGSHVPNTFGGGTKLEIK/RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC

>XENP022553 1C11[PD-1]_H3L3_IgG1_PVA_/S267K Heavy Chain (SEQ ID NO: 154)
QIQLVQSGSELKKPGASVKVSCKASGYTFTHYGMNWVRQAPGQGLEWMGWINTYTGEPTYADGFTGRFVFSLDTSVS
TAYLQISSLKAEDTAVYFCARDYYGSSPYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

>XENP022553 1C11[PD-1]_H3L3_IgG1_PVA_/S267K Light Chain (SEQ ID NO: 155)
DVLMTQSPDSLAVSLGERATINCKSSQSIVHSNGNTYLEWYQQKPGQSPKLLIYKVSNRFSGVPDRFSGSGSGTDFT
LTISSLQAEDVAVYYCFQGSHVPNTFGGGTKVEIK/RTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPVTKSFNRGEC

Figure 26

>XENP28519 mAb A[PD-1]_H1L1_IgG1_PVA_/S267K

XENP28519 Chain 1 - mAb A[PD-1]_H1_IgG1_PVA_/S267K Heavy Chain (SEQ ID NO: 156)

QVQLQESGPGLVKPSQTLSLTCTVSGHSITSDYAWNWIRQPPGKKLEWIGYISYSGYTTYNPSLKSRVTISRDTSKN
QFSLKLSSVTAADTAVYFCARDLDYGPWFAYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREEMTKNQVSLTCLVKGFYPSDIAVEWES
NGQPENNYKTTPPVLDSDGSFFLYSKLTVDKSRWQQGNVFSCSVMHEALHNHYTQKSLSLSPGK

XENP28519 Chain 2 - mAb A[PD-1]_L1 Light Chain (SEQ ID NO: 157)

DIQMTQSPSSLSASVGDRVTITCRASENIHNYLAWYQQKPGKSPKLLVYNVKTLADGVPSRFSGSGSGTDYTLTISS
LQPEDFATYYCQHFWSSPWTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP28686 mAb B[PD-1]_H1L1_IgG1_PVA_/S267K

XENP28686 Chain 1 - mAb B[PD-1]_H1_IgG1_PVA_/S267K Heavy Chain (SEQ ID NO: 158)

QVQLVQSGAEVKKPGASVKVSCKASGYTFTNFYIHWVRQAPGQSIEWMGSIYPNYGDTAYNQKFQGRVTMTVDKSIS
TAYMELSRLRSDDTAVYYCARGYSYAMDYWGQGTTVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREEMTKNQVSLTCLVKGFYPSDIAVEWESNG
QPENNYKTTPPVLDSDGSFFLYSKLTVDKSRWQQGNVFSCSVMHEALHNHYTQKSLSLSPGK

XENP28686 Chain 2 - mAb B[PD-1]_L1 Light Chain (SEQ ID NO: 159)

DIQMTQSPSSLSASVGDRVTITCRASQGISGDLNWYQQKPGKTVKLLIYHTSSLHSGVPLRFSGSGSGTDYTLTISS
LQPEDFATYYCQYYSKDLLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 27

|  | XENP16432 | XENP21461 | 1C11-based mAb | chmAb A | chmAb B | PDL1-Fc |
|---|---|---|---|---|---|---|
| XENP16432 | 0.0468 | 0.0143 | 0.2899 | 0.9692 | 0.9299 | 0.1582 |
| XENP21461 | 0.0816 | 0.0301 | 0.405 | 0.8851 | 0.8542 | 0.1585 |
| 1C11-based mAb | -0.068 | 0.392 | 0.0987 | 0.8468 | 0.098 | -0.0232 |
| chmAb A | 1.0095 | 1.0145 | 0.9657 | 0.0141 | 0.0157 | 0.5737 |
| chmAb B | 0.8889 | 0.9079 | 0.253 | 0.0372 | 0.0372 | 0.2058 |
| HBS-EP | 1 | 1 | 1 | 1 | 1 | 1 |
| PDL1-Fc | 0.5418 | 0.5045 | 0.6211 | 0.9274 | 0.9142 | 0.3162 | scIL-15/Rα x scFv scFv x ncIL-15/Rα scIL-15/Rα x Fab

Fab x ncIL-15/Rα mAb-scIL-15/Rα mAb-ncIL-15/Rα central-IL-15/Rα central-scIL-15/Rα

Figure 29

XENP025850 human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q

Chain 1 - 1C11[PD-1]_H3L3_IgG1_PVA_/S267K/S364K/E357Q (SEQ ID NO: 160)
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPY
WGQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKV
DKKVEPKSCDKTHTCPPCPAPPVAGPSVFLFPPKPKDTLMISRTPEVTCVVVDVSKHEDPEVKFNWYVDGVEVHNAKTKPREEQYNSTYRVVSVLTVLHQDWLNGKE
YKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFS
CSVMHEALHNHYTQKSLSLSPGK Chain 2 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 161)
*ITCPPPMSVEHADIWVKSYSLYSRERYICNSGFKRKAGTSSLTECVLNKATNVAHWTTPSLKCIR/GGGGSGGGGSGGGGSGGGGSGGGGS/NWVDVISDLKKIED
LIQSMHIDATLYTESDVHPSCKVTAMKCFLLELQVISLESGDASIHDTVEDLIILANNSLSSNGNVTESGCKECEELEEKNIKEFLQSFVHIVQMFINTS/EPKSS
DKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK*

Chain 3 - 1C11[PD-1]_L3 (SEQ ID NO: 162)
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGG
TKVEIK/RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVT
KSFNRGEC

>XENP025937 human_IL15Ra(sushi)_(GGGGS)5-human_IL15(N4D/N65D;single-Chain)-1C11[PD-1]_H3L3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

*Chain 1 - XENP025937 human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S/M428L/N434S (SEQ ID NO: 163)*

*ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK*

*Chain 2 - XENP025937 1C11[PD-1]_H3L3_IgG1_PVA_/S267K/S364K/E357Q/M428L/N434S (SEQ ID NO: 164)*

QIQLVQSGSELKKPGASVKVSCKASGYTFTHYGMNWVRQAPGQGLEWMGWINTYTGEPTYADGFTGRFVFSLDTSVSTAYLQISSL
KAEDTAVYFCARDYYGSSPYWGQGTLVTVSS/ASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPAPPVAGPSVFLFPPKPKDTLMISRTPE
VTCVVVDVKHEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGNVFSCSVLHE
ALHSHYTQKSLSLSPGK

*Chain 3 - XENP025937 1C11[PD-1]_L3 (SEQ ID NO: 165)*

DVLMTQSPDSLAVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK/RTVAAPSVFIFPPSDEQLKSGTASVVCLLNNFYPREAKVQWKVDNALQSGNSQESVTEQ
DSKDSTYSLSSTLTLSKADYEKHKVYACEVTHQGLSSPVTKSFNRGEC

Figure 30

>XENP28532 human_IL15Ra(sushi)_(GGGGS)5-human_IL15(N4D/N65D;single-Chain)-mAb A[PD-1]_H1L1_IgG1_Fc(216)_IgG1_pI(-)_Isosteric_A_C220S/PVA_/S267K/L368D/K370S-IgG1_PVA_/S267K/S364K/E357Q XENP28532 Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Rα-Fc Chain (SEQ ID NO: 166)
*ITCPPPMSVEHADIWVKSYSLYSRERYICNSGFKRKAGTSSLTECVLNKATNVAHWTTPSLKCIR*/GGGGSGGGGSG
GGGSGGGGSGGGGS/*NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS*/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK XENP28532 Chain 2 - mAb A[PD-1]_H1_IgG1_PVA_/S267K/S364K/E357Q Heavy Chain (SEQ ID NO: 167)
QVQLQESGPGLVKPSQTLSLTCTVSGHSITSDYAWNWIRQPPGKKLEWIGYISYSGYTTYNPSLKSRVTISRDTSKN
QFSLKLSSVTAADTAVYFCARDLDYGPWFAYWGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK XENP28532 Chain 3 - mAb A[PD-1]_L1 Light Chain (SEQ ID NO: 168)
DIQMTQSPSSLSASVGDRVTITCRASENIHNYLAWYQQKPGKSPKLLVYNVKTLADGVPSRFSGSGSGTDYTLTISS
LQPEDFATYYCQHFWSSPWTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC >XENP28692 human_IL15Ra(sushi)_(GGGGS)5-human_IL15(N4D/N65D;single-Chain)-mAb B[PD-1]_H1L1_IgG1_Fc(216)_IgG1_pI(-)_Isosteric_A_C220S/PVA_/S267K/L368D/K370S-IgG1_PVA_/S267K/S364K/E357Q XENP28692 Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Rα-Fc Chain (SEQ ID NO: 169)
*ITCPPPMSVEHADIWVKSYSLYSRERYICNSGFKRKAGTSSLTECVLNKATNVAHWTTPSLKCIR*/GGGGSGGGGSG
GGGSGGGGSGGGGS/*NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS*/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK XENP28692 Chain 2 - mAb B[PD-1]_H1_IgG1_PVA_/S267K/S364K/E357Q Heavy Chain (SEQ ID NO: 170)
QVQLVQSGAEVKKPGASVKVSCKASGYTFTNFYIHWVRQAPGQSIEWMGSIYPNYGDTAYNQKFQGRVTMTVDKSIS
TAYMELSRLRSDDTAVYYCARGYSYAMDYWGQGTTVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

Figure 31A

XENP28692 Chain 3 - mAb B[PD-1]_L1 Light Chain (SEQ ID NO: 171)
DIQMTQSPSSLSASVGDRVTITC<u>RASQGISGDLN</u>WYQQKPGKTVKLLIY<u>HTSSLHS</u>GVPLRFSGSGSGTDYTLTISS
LQPEDFATYYC<u>QYYSKDLLT</u>FGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC <u>>XENP30455 human_IL15Ra(sushi)_(GGGGS)5-human_IL15(D30N/E64Q/N65D;single-chain)-mAb A[PD-
1]_H1L1_IgG1_Fc(216)_IgG1_pI(-)_Isosteric_A_C220S/PVA_/S267K/L368D/K370S-
IgG1_PVA_/S267K/S364K/E357Q</u>

**Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S (SEQ ID NO: 172)**
*ITCPPPMSVEHADIWVKSYSLYSRERYICNSGFKRKAGTSSLTECVLNKATNVAHWTTPSLKCIR*/<u>*GGGGSGGGGS*
*GGGSGGGGSGGGGS*</u>/*NWVNVISDLKKIEDLIQSMHIDATLYTESNVHPSCKVTAMKCFLLELQVISLESGDASIHDT*
*VQDLIILANNSLSSNGNVTESGCKECEELEEKNIKEFLQSFVHIVQMFINTS*/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

**Chain 2 - mAb A[PD-1]_H1L1_IgG1_Fc(216)_IgG1_pI(-)_Isosteric_A_C220S/PVA_/S267K/L368D/K370S-
IgG1_PVA_/S267K/S364K/E357Q (SEQ ID NO: 173)**
QVQLQESGPGLVKPSQTLSLTCTVSGHSITS<u>DYAWN</u>WIRQPPGKKLEWIG<u>YISYSGYTTYNPSLKS</u>RVTISRDTSKN
QFSLKLSSVTAADTAVYFCAR<u>DLDYGPWFAY</u>WGQGTLVTVSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK

Chain 3 - mAb A[PD-1]_L1 (SEQ ID NO: 174)
DIQMTQSPSSLSASVGDRVTITC<u>RASENIHNY</u>LAWYQQKPGKSPKLLVY<u>NVKTLAD</u>GVPSRFSGSGSGTDYTLTISS
LQPEDFATYYC<u>QHFWSSPWT</u>FGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC <u>>XENP29440 human_IL15Ra(sushi)_(GGGGS)5-human_IL15(N4D/N65D;single-Chain)-mAb A[PD-
1]_H1L1_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S</u>

**XENP29440 Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S/M428L/N434S scIL-15/Rα-Fc Chain (SEQ ID NO: 175)**
*ITCPPPMSVEHADIWVKSYSLYSRERYICNSGFKRKAGTSSLTECVLNKATNVAHWTTPSLKCIR*/<u>*GGGGSGGGGS*
*GGGSGGGGSGGGGS*</u>/*NWVDVISDLKKIEDLIQSMHIDATLYTESDVHPSCKVTAMKCFLLELQVISLESGDASIHDT*
*VEDLIILANNSLSSNGNVTESGCKECEELEEKNIKEFLQSFVHIVQMFINTS*/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVLHEALHSHYTQKSLSLSPGK

Figure 31B

XENP29440 Chain 2 - mAb A[PD-1]_H1L1_IgG1_PVA_/S267K/S364K/E357Q/M428L/N434S Heavy Chain (SEQ ID NO: 176)
QVQLQESGPGLVKPSQTLSLTCTVSGHSITSDYAWNWIRQPPGKKLEWIGYISYSGYTTYNPSLKSRVTISRDTSKNQFSLK
LSSVTAADTAVYFCARDLDYGPWFAYWGQGTLVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKVSNK
ALPAPIEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVLHEALHSHYTQKSLSLSPGK

XENP29440 Chain 3 - mAb A[PD-1]_L1 Light Chain (SEQ ID NO: 177)
DIQMTQSPSSLSASVGDRVTITCRASENIHNYLAWYQQKPGKSPKLLVYNVKTLADGVPSRFSGSGSGTDYTLTISS
LQPEDFATYYCQHFWSSPWTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP29441 human_IL15Ra(sushi)_(GGGGS)5-human_IL15(N4D/N65D;single-Chain)-mAb B[PD-1]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

XENP29441 Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S/M428L/N434S scIL-15/Rα-Fc Chain (SEQ ID NO: 178)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVLHEALHSHYTQKSLSLSPGK

XENP29441 Chain 2 - mAb B[PD-1]_H1_IgG1_PVA_/S267K/S364K/E357Q/M428L/N434S Heavy Chain (SEQ ID NO: 179)
QVQLVQSGAEVKKPGASVKVSCKASGYTFTNFYIHWVRQAPGQSIEWMGSIYPNYGDTAYNQKFQGRVTMTVDKSISTAYMELSRL
RSDDTAVYYCARGYSYAMDYWGQGTTVTVSS/ASTKGPSVFPLAPSSKSTSGGTAALGCLVKDYFPEPVTVSWNSGALTSGVHTFP
AVLQSSGLYSLSSVVTVPSSSLGTQTYICNVNHKPSNTKVDKKVEPKSCDKTHTCPPCPAPPVAGPSVFLFPPKPKDTLMISRTPE
VTCVVVDVKHEDPEVKFNWYVDGVEVHNAKTKPREEQYNSTYRVVSVLTVLHQDWLNGKEYKCKVSNKALPAPIEKTISKAKGQPR
EPQVYTLPPSREQMTKNQVKLTCLVKGFYPSDIAVEWESNGQPENNYKTTPPVLDSDGSFFLYSKLTVDKSRWQQGNVFSCSVLHE
ALHSHYTQKSLSLSPGK

XENP29441 Chain 3 - mAb B[PD-1]_L1 Light Chain (SEQ ID NO: 180)
DIQMTQSPSSLSASVGDRVTITCRASQGISGDLNWYQQKPGKTVKLLIYHTSSLHSGVPLRFSGSGSGTDYTLTISS
LQPEDFATYYCQYYSKDLLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 31C

>XENP26007 human_IL15Ra(sushi)_(GGGGS)5-human_IL15(N4D/N65D;single-Chain)-Numax_IgG1_Fc(216)_IgG1_pI(-)_Isosteric_A_C220S/PVA_/S267K/L368D/K370S-IgG1_PVA_/S267K/S364K/E357Q

XENP26007 Chain 1 - human_IL15Ra(sushi)_(GGGGS)5-human_IL15(N4D/N65D;single-Chain)_Fc(216)_IgG1_pI(-)_Isosteric_A_C220S/PVA_/S267K/L368D/K370S scIL-15/Rα-Fc Chain (SEQ ID NO: 181)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVDVISDLKKIEDLIQSMHIDATLYTESDVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

XENP26007 Chain 2 - Numax_IgG1_PVA_/S267K/S364K/E357Q Heavy Chain (SEQ ID NO: 182)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

XENP26007 Chain 3 - Numax Light Chain (SEQ ID NO: 183)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

>XENP30432 human_IL15Ra(sushi)_(GGGGS)5-human_IL15(D30N/E64Q/N65D;single-chain)-Numax_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 184)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESNVHPSCKVTAMKCFLLELQVISLESGDASIHDT
VQDLIILANNSLSSNGNVTESGCKECEELEEKNIKEFLQSFVHIVQMFINTSEPKSSDKTHTCPPCPAPPVAGPSVF
LFPPKPKDTLMISRTPEVTCVVVDVKHEDPEVKFNWYVDGVEVHNAKTKPREEEYNSTYRVVSVLTVLHQDWLNGKE
YKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - Numax_VH_IgG1_IgG1_PVA_/S267K/S364K/E357Q (SEQ ID NO: 185)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

Figure 31D

Chain 3 - Numax LC (SEQ ID NO: 186)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

**>XENP29481 human_IL15Ra(sushi)_(GGGGS)5-human_IL15(D30N/N65D;single-chain)-
Numax_IgG1_Fc(216)_IgG1_pI(-)_Isosteric_A_C220S/PVA_/S267K/L368D/K370S-
IgG1_PVA_/S267K/S364K/E357Q**

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S** (SEQ ID NO: 187)
ITCPPPMSVEHADIWVKSYSLYSRERYICNSGFKRKAGTSSLTECVLNKATNVAHWTTPSLKCIR/GGGGSGGGGSG
GGGSGGGGSGGGGS/NWVNVISDLKKIEDLIQSMHIDATLYTESNVHPSCKVTAMKCFLLELQVISLESGDASIHDT
VEDLIILANNSLSSNGNVTESGCKECEELEEKNIKEFLQSFVHIVQMFINTS/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

Chain 2 - Numax_IgG1_PVA_/S267K/S364K/E357Q (SEQ ID NO: 188)
QVTLRESGPALVKPTQTLTLTCTFSGFSLSTAGMSVGWIRQPPGKALEWLADIWWDDKKHYNPSLKDRLTISKDTSK
NQVVLKVTNMDPADTATYYCARDMIFNFYFDVWGQGTTVTVSS/ASTKGPSVFPLAPSSKSTSGGTAALGCLVKDYF
PEPVTVSWNSGALTSGVHTFPAVLQSSGLYSLSSVVTVPSSSLGTQTYICNVNHKPSNTKVDKKVEPKSCDKTHTCP
PCPAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

Chain 3 - Numax LC (SEQ ID NO: 189)
DIQMTQSPSTLSASVGDRVTITCSASSRVGYMHWYQQKPGKAPKLLIYDTSKLASGVPSRFSGSGSGTEFTLTISSL
QPDDFATYYCFQGSGYPFTFGGGTKVEIK/RTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

Figure 42

>XENP29484 human_IL15Ra(sushi)_(GGGGS)5-human_IL15(D30N/N65D;single-Chain)-mAb A[PD-1]_H1L1_IgG1_Fc(216)_IgG1_pI(-)_Isosteric_A_C220S/PVA_/S267K/L368D/K370S-IgG1_PVA_/S267K/S364K/E357Q

XENP29484 Chain 1 - human_IL15Ra(sushi)_(GGGGS)5-human_IL15(D30N/N65D;single-Chain)_Fc(216)_IgG1_pI(-)_Isosteric_A_C220S/PVA_/S267K/L368D/K370S scIL-15/Rα-Fc Chain (SEQ ID NO: 190)
*ITCPPPMSVEHADIWVKSYSLYSRERYICNSGFKRRAGTSSLTECVLNKATNVAHWTTPSLKCIR*/GGGGSGGGGSG
GGGSGGGGSGGGGS/*NWVNVISDLKKIEDLIQSMHIDATLYTESNVHPSCKVTAMKCFLLELQVISLESGDASIHDT
VEDLIILANNSLSSNGNVTESGCKECEELEEKNIKEFLQSFVHIVQMFINTS*/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

XENP29484 Chain 2 - mAb A[PD-1]_H1_IgG1_PVA_/S267K/S364K/E357Q Heavy Chain (SEQ ID NO: 191)
QVQLQESGPGLVKPSQTLSLTCTVSGHSITSDYAWNWIRQPPGKKLEWIGYISYSGYTTYNPSLKSRVTISRDTSKN
QFSLKLSSVTAADTAVYFCARDLDYGPWFAYWGQGTLVTSS/ASTKGPSVFPLAPSSKSTSGGTAALGCLVKDYFP
EPVTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK

XENP29484 Chain 3 - mAb A[PD-1]_L1 Light Chain (SEQ ID NO: 192)
DIQMTQSPSSLSASVGDRVTITCRASENIHNYLAWYQQKPGKSPKLLVYNVKTLADGVPSRFSGSGSGTDYTLTISS
LQPEDFATYYCQHFWSSPWTFGGGTKVEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

>XENP29485 human_IL15Ra(sushi)_(GGGGS)5-human_IL15(D30N/N65D;single-Chain)-mAb B[PD-1]_H1L1_IgG1_Fc(216)_IgG1_pI(-)_Isosteric_A_C220S/PVA_/S267K/L368D/K370S-IgG1_PVA_/S267K/S364K/E357Q

XENP29485 Chain 1 - human_IL15Ra(sushi)_(GGGGS)5-human_IL15(D30N/N65D;single-Chain)_Fc(216)_IgG1_pI(-)_Isosteric_A_C220S/PVA_/S267K/L368D/K370S scIL-15/Rα-Fc Chain (SEQ ID NO: 193)
*ITCPPPMSVEHADIWVKSYSLYSRERYICNSGFKRRAGTSSLTECVLNKATNVAHWTTPSLKCIR*/GGGGSGGGGSG
GGGSGGGGSGGGGS/*NWVNVISDLKKIEDLIQSMHIDATLYTESNVHPSCKVTAMKCFLLELQVISLESGDASIHDT
VEDLIILANNSLSSNGNVTESGCKECEELEEKNIKEFLQSFVHIVQMFINTS*/EPKSSDKTHTCPPCPAPPVAGPSV
FLFPPKPKDTLMISRTPEVTCVVVDVKHEDPEVKFNWYVDGVEVHNAKTKPREEEYNSTYRVVSVLTVLHQDWLNGK
EYKCKVSNKALPAPIEKTISKAKGQPREPQVYTLPPSREEMTKNQVSLTCDVSGFYPSDIAVEWESDGQPENNYKTT
PPVLDSDGSFFLYSKLTVDKSRWEQGDVFSCSVMHEALHNHYTQKSLSLSPGK

XENP29485 Chain 2 - mAb B[PD-1]_H1_IgG1_PVA_/S267K/S364K/E357Q Heavy Chain (SEQ ID NO: 194)
QVQLVQSGAEVKKPGASVKVSCKASGYTFTNFYIHWVRQAPGQSIEWMGSIYPNYGDTAYNQKFQGRVTMTVDKSIS
TAYMELSRLRSDDTAVYYCARGYSYAMDYWGQGTTVTSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPPCP
APPVAGPSVFLFPPKPKDTLMISRTPEVTCVVVDVKHEDPEVKFNWYVDGVEVHNAKTKPREEQYNSTYRVVSVLTV
LHQDWLNGKEYKCKVSNKALPAPIEKTISKAKGQPREPQVYTLPPSREQMTKNQVKLTCLVKGFYPSDIAVEWESNG
QPENNYKTTPPVLDSDGSFFLYSKLTVDKSRWQQGNVFSCSVMHEALHNHYTQKSLSLSPGK

XENP29485 Chain 3 - mAb B[PD-1]_L1 Light Chain (SEQ ID NO: 195)
DIQMTQSPSSLSASVGDRVTITCRASQGISGDLNWYQQKPGKTVKLLIYHTSSLHSGVPLRFSGSGSGTDYTLTISS
LQPEDFATYYCQYYSKDLLTFGAGTKLEIK/RTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC

Figure 43A mAb A[PD-1]_H1 (SEQ ID NO: 196)
QVQLQESGPGLVKPSQTLSLTCTVSGHSITSDYAWNWIRQPPGKKLEWIGYISYSGYTTYNPSLKSRVTISRDTSKNQFSLKLSSV
TAADTAVYFCARDLDYGPWFAYWGQGTLVTVSS mAb A[PD-1]_L1 (SEQ ID NO: 197)
DIQMTQSPSSLSASVGDRVTITCRASENIHNYLAWYQQKPGKSPKLLVYNVKTLADGVPSRFSGSGSGTDYTLTISSLQPEDFATY
YCQHFWSSPWTFGGGTKVEIK mAb B[PD-1]_H1 (SEQ ID NO: 198)
QVQLVQSGAEVKKPGASVKVSCKASGYTFTNFYIHWVRQAPGQSIEWMGSIYPNYGDTAYNQKFQGRVTMTVDKSISTAYMELSRL
RSDDTAVYYCARGYSYAMDYWGQGTTVTVSS mAb B[PD-1]_L1 (SEQ ID NO: 199)
DIQMTQSPSSLSASVGDRVTITCRASQGISGDLNWYQQKPGKTVKLLIYHTSSLHSGVPLRFSGSGSGTDYTLTISSLQPEDFATY
YCQYYSKDLLTFGAGTKLEIK mAb C[PD-1]_H1 (SEQ ID NO:5)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS mAb C[PD-1]_L1 (SEQ ID NO:6)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK mAb C[PD1]_H1.1 (SEQ ID NO: 200)
EVQLVESGGGLVQPGGSLRLSCAASGFTFTSFGMHWVRQAPGKGLEWVSYISSGSSIYYADSVKGRFTISRDNAKNSLYLQMNSLRAEDTAVYYCA
RGGRLVWSPDYWGQGTLVTVSS mAb C[PD1]_H1.2 (SEQ ID NO: 201)
EVQLVESGGGLVQPGGSLRLSCAASGFTFASFGMHWVRQAPGKGLEWVSYISSGSSIYYADSVKGRFTISRDNAKNSLYLQMNSLRAEDTAVYYC
ARGGRLVWSPDYWGQGTLVTVSS >mAb C[PD1]_H1.3 (SEQ ID NO: 202)
EVQLVESGGGLVQPGGSLRLSCAASGFTFQSFGMHWVRQAPGKGLEWVSYISSGSSIYYADSVKGRFTISRDNAKNSLYLQMNSLRAEDTAVYYC
ARGGRLVWSPDYWGQGTLVTVSS >mAb C[PD1]_H1.4 (SEQ ID NO: 203)
EVQLVESGGGLVQPGGSLRLSCAASGFTFGSFGMHWVRQAPGKGLEWVSYISSGSSIYYADSVKGRFTISRDNAKNSLYLQMNSLRAEDTAVYYC
ARGGRLVWSPDYWGQGTLVTVSS >mAb C[PD1]_H1.5 (SEQ ID NO: 204)
EVQLVESGGGLVQPGGSLRLSCAASGFTFVSFGMHWVRQAPGKGLEWVSYISSGSSIYYADSVKGRFTISRDNAKNSLYLQMNSLRAEDTAVYYC
ARGGRLVWSPDYWGQGTLVTVSS >mAb C[PD1]_H1.6 (SEQ ID NO: 205)
EVQLVESGGGLVQPGGSLRLSCAASGFTFHSFGMHWVRQAPGKGLEWVSYISSGSSIYYADSVKGRFTISRDNAKNSLYLQMNSLRAEDTAVYYC
ARGGRLVWSPDYWGQGTLVTVSS >mAb C[PD1]_H1.7 (SEQ ID NO: 206)
EVQLVESGGGLVQPGGSLRLSCAASGFTFKSFGMHWVRQAPGKGLEWVSYISSGSSIYYADSVKGRFTISRDNAKNSLYLQMNSLRAEDTAVYYCA
RGGRLVWSPDYWGQGTLVTVSS >mAb C[PD1]_H1.8 (SEQ ID NO: 207)
EVQLVESGGGLVQPGGSLRLSCAASGFTFYSFGMHWVRQAPGKGLEWVSYISSGSSIYYADSVKGRFTISRDNAKNSLYLQMNSLRAEDTAVYYCA
RGGRLVWSPDYWGQGTLVTVSS

Figure 43B

>mAb C[PD1]_H1.9 (SEQ ID NO: 208)
EVQLVESGGGLVQPGGSLRLSCAASGFTFS<u>TFGMH</u>WVRQAPGKGLEWVS<u>YISSGSSIIYYADSVKG</u>RFTISRDNAKNSLYLQMNSLRAEDTAVYYCA
R<u>GGRLVWSPDY</u>WGQGTLVTVSS

>mAb C[PD1]_H1.10 (SEQ ID NO: 209)
EVQLVESGGGLVQPGGSLRLSCAASGFTFS<u>AFGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.11 (SEQ ID NO: 210)
EVQLVESGGGLVQPGGSLRLSCAASGFTFS<u>QFGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.12 (SEQ ID NO: 211)
EVQLVESGGGLVQPGGSLRLSCAASGFTFS<u>GFGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.13 (SEQ ID NO: 212)
EVQLVESGGGLVQPGGSLRLSCAASGFTFS<u>VFGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.14 (SEQ ID NO: 213)
EVQLVESGGGLVQPGGSLRLSCAASGFTFS<u>HFGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.15 (SEQ ID NO: 214)
EVQLVESGGGLVQPGGSLRLSCAASGFTFS<u>DFGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.16 (SEQ ID NO: 215)
EVQLVESGGGLVQPGGSLRLSCAASGFTFS<u>KFGMH</u>WVRQAPGKGLEWVS<u>YISSGSSIIYYADSVKG</u>RFTISRDNAKNSLYLQMNSLRAEDTAVYYCA
R<u>GGRLVWSPDY</u>WGQGTLVTVSS

>mAb C[PD1]_H1.17 (SEQ ID NO: 216)
EVQLVESGGGLVQPGGSLRLSCAASGFTFS<u>YFGMH</u>WVRQAPGKGLEWVS<u>YISSGSSIIYYADSVKG</u>RFTISRDNAKNSLYLQMNSLRAEDTAVYYCA
R<u>GGRLVWSPDY</u>WGQGTLVTVSS

>mAb C[PD1]_H1.18 (SEQ ID NO: 217)
EVQLVESGGGLVQPGGSLRLSCAASGFTFS<u>SYGMH</u>WVRQAPGKGLEWVS<u>YISSGSSIIYYADSVKG</u>RFTISRDNAKNSLYLQMNSLRAEDTAVYYCA
R<u>GGRLVWSPDY</u>WGQGTLVTVSS

>mAb C[PD1]_H1.19 (SEQ ID NO: 218)
EVQLVESGGGLVQPGGSLRLSCAASGFTFS<u>SLGMH</u>WVRQAPGKGLEWVS<u>YISSGSSIIYYADSVKG</u>RFTISRDNAKNSLYLQMNSLRAEDTAVYYCA
R<u>GGRLVWSPDY</u>WGQGTLVTVSS

>mAb C[PD1]_H1.20 (SEQ ID NO: 219)
EVQLVESGGGLVQPGGSLRLSCAASGFTFS<u>SWGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS

>mAb C[PD1]_H1.21 (SEQ ID NO: 220)
EVQLVESGGGLVQPGGSLRLSCAASGFTFS<u>SIGMH</u>WVRQAPGKGLEWVS<u>YISSGSSIIYYADSVKG</u>RFTISRDNAKNSLYLQMNSLRAEDTAVYYCA
R<u>GGRLVWSPDY</u>WGQGTLVTVSS

>mAb C[PD1]_H1.22 (SEQ ID NO: 221)
EVQLVESGGGLVQPGGSLRLSCAASGFTFS<u>SHGMH</u>WVRQAPGKGLEWVS<u>YISSGSSIIYYADSVKG</u>RFTISRDNAKNSLYLQMNSLRAEDTAVYYC
AR<u>GGRLVWSPDY</u>WGQGTLVTVSS/

Figure 43C

>mAb C[PD1]_H1.23 (SEQ ID NO: 222)
EVQLVESGGGLVQPGGSLRLSCAASGFTFSSQGMHWVRQAPGKGLEWVSYISSGSSIIYYADSVKGRFTISRDNAKNSLYLQMNSLRAEDTAVYYC
ARGGRLVWSPDYWGQGTLVTVSS

>mAb C[PD1]_H1.24 (SEQ ID NO: 223)
EVQLVESGGGLVQPGGSLRLSCAASGFTFSSSGMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.25 (SEQ ID NO: 224)
EVQLVESGGGLVQPGGSLRLSCAASGFTFSSKGMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.26 (SEQ ID NO: 225)
EVQLVESGGGLVQPGGSLRLSCAASGFTFSSFAMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.27 (SEQ ID NO: 226)
EVQLVESGGGLVQPGGSLRLSCAASGFTFSSFSMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.28 (SEQ ID NO: 227)
EVQLVESGGGLVQPGGSLRLSCAASGFTFSSFTMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.29 (SEQ ID NO: 228)
EVQLVESGGGLVQPGGSLRLSCAASGFTFSSFNMHWVRQAPGKGLEWVSYISSGSSIIYYADSVKGRFTISRDNAKNSLYLQMNSLRAEDTAVYYCA
RGGRLVWSPDYWGQGTLVTVSS/

>mAb C[PD1]_H1.30 (SEQ ID NO: 229)
EVQLVESGGGLVQPGGSLRLSCAASGFTFSSFHMHWVRQAPGKGLEWVSYISSGSSIIYYADSVKGRFTISRDNAKNSLYLQMNSLRAEDTAVYYCA
RGGRLVWSPDYWGQGTLVTVSS/

>mAb C[PD1]_H1.31 (SEQ ID NO: 230)
EVQLVESGGGLVQPGGSLRLSCAASGFTFSSFDMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.32 (SEQ ID NO: 231)
EVQLVESGGGLVQPGGSLRLSCAASGFTFSSFKMHWVRQAPGKGLEWVSYISSGSSIIYYADSVKGRFTISRDNAKNSLYLQMNSLRAEDTAVYYCA
RGGRLVWSPDYWGQGTLVTVSS/

>mAb C[PD1]_H1.33 (SEQ ID NO: 232)
EVQLVESGGGLVQPGGSLRLSCAASGFTFSSFLMHWVRQAPGKGLEWVSYISSGSSIIYYADSVKGRFTISRDNAKNSLYLQMNSLRAEDTAVYYCA
RGGRLVWSPDYWGQGTLVTVSS/

>mAb C[PD1]_H1.34 (SEQ ID NO: 233)
EVQLVESGGGLVQPGGSLRLSCAASGFTFSSFYMHWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.35 (SEQ ID NO: 234)
EVQLVESGGGLVQPGGSLRLSCAASGFTFSSFGMNWVRQAPGKGLEWVSYISSGSSIIYYADSVKGRFTISRDNAKNSLYLQMNSLRAEDTAVYYCA
RGGRLVWSPDYWGQGTLVTVSS

>mAb C[PD1]_H1.36 (SEQ ID NO: 235)
EVQLVESGGGLVQPGGSLRLSCAASGFTFSSFGMHWVRQAPGKGLEWVSYITSGSSIIYYADSVKGRFTISRDNAKNSLYLQMNSLRAEDTAVYYCA
RGGRLVWSPDYWGQGTLVTVSS

Figure 43D

>mAb C[PD1]_H1.37 (SEQ ID NO: 236)
EVQLVESGGGLVQPGGSLRLSCAASGFTFSSFGMHWVRQAPGKGLEWVSYIASGSSIIYYADSVKGRFTISRDNAKNSLYLQMNSLRAEDTAVYYC
ARGGRLVWSPDYWGQGTLVTVSS

>mAb C[PD1]_H1.38 (SEQ ID NO: 237)
EVQLVESGGGLVQPGGSLRLSCAASGFTFSSFGMHWVRQAPGKGLEWVSYIQSGSSIIYYADSVKGRFTISRDNAKNSLYLQMNSLRAEDTAVYYC
ARGGRLVWSPDYWGQGTLVTVSS

>mAb C[PD1]_H1.39 (SEQ ID NO: 238)
EVQLVESGGGLVQPGGSLRLSCAASGFTFSSFGMHWVRQAPGKGLEWVSYIGSGSSIIYYADSVKGRFTISRDNAKNSLYLQMNSLRAEDTAVYYC
ARGGRLVWSPDYWGQGTLVTVSS

>mAb C[PD1]_H1.40 (SEQ ID NO: 239)
EVQLVESGGGLVQPGGSLRLSCAASGFTFSSFGMHWVRQAPGKGLEWVSYIVSGSSIIYYADSVKGRFTISRDNAKNSLYLQMNSLRAEDTAVYYC
ARGGRLVWSPDYWGQGTLVTVSS

>mAb C[PD1]_H1.41 (SEQ ID NO: 240)
EVQLVESGGGLVQPGGSLRLSCAASGFTFSSFGMHWVRQAPGKGLEWVSYIHSGSSIIYYADSVKGRFTISRDNAKNSLYLQMNSLRAEDTAVYYC
ARGGRLVWSPDYWGQGTLVTVSS

>mAb C[PD1]_H1.42 (SEQ ID NO: 241)
EVQLVESGGGLVQPGGSLRLSCAASGFTFSSFGMHWVRQAPGKGLEWVSYIKSGSSIIYYADSVKGRFTISRDNAKNSLYLQMNSLRAEDTAVYYCA
RGGRLVWSPDYWGQGTLVTVSS

>mAb C[PD1]_H1.43 (SEQ ID NO: 242)
EVQLVESGGGLVQPGGSLRLSCAASGFTFSSFGMHWVRQAPGKGLEWVSYIYSGSSIIYYADSVKGRFTISRDNAKNSLYLQMNSLRAEDTAVYYCA
RGGRLVWSPDYWGQGTLVTVSS

>mAb C[PD1]_H1.44 (SEQ ID NO: 243)
EVQLVESGGGLVQPGGSLRLSCAASGFTFSSFGMHWVRQAPGKGLEWVSYIESGSSIIYYADSVKGRFTISRDNAKNSLYLQMNSLRAEDTAVYYCA
RGGRLVWSPDYWGQGTLVTVSS

>mAb C[PD1]_H1.45 (SEQ ID NO: 244)
EVQLVESGGGLVQPGGSLRLSCAASGFTFSSFGMHWVRQAPGKGLEWVSYISTGSSIIYYADSVKGRFTISRDNAKNSLYLQMNSLRAEDTAVYYCA
RGGRLVWSPDYWGQGTLVTVSS

>mAb C[PD1]_H1.46 (SEQ ID NO: 245)
EVQLVESGGGLVQPGGSLRLSCAASGFTFSSFGMHWVRQAPGKGLEWVSYISAGSSIIYYADSVKGRFTISRDNAKNSLYLQMNSLRAEDTAVYYC
ARGGRLVWSPDYWGQGTLVTVSS

>mAb C[PD1]_H1.47 (SEQ ID NO: 246)
EVQLVESGGGLVQPGGSLRLSCAASGFTFSSFGMHWVRQAPGKGLEWVSYISQGSSIIYYADSVKGRFTISRDNAKNSLYLQMNSLRAEDTAVYYC
ARGGRLVWSPDYWGQGTLVTVSS

>mAb C[PD1]_H1.48 (SEQ ID NO: 247)
EVQLVESGGGLVQPGGSLRLSCAASGFTFSSFGMHWVRQAPGKGLEWVSYISGGSSIIYYADSVKGRFTISRDNAKNSLYLQMNSLRAEDTAVYYC
ARGGRLVWSPDYWGQGTLVTVSS

>mAb C[PD1]_H1.49 (SEQ ID NO: 248)
EVQLVESGGGLVQPGGSLRLSCAASGFTFSSFGMHWVRQAPGKGLEWVSYISVGSSIIYYADSVKGRFTISRDNAKNSLYLQMNSLRAEDTAVYYC
ARGGRLVWSPDYWGQGTLVTVSS

>mAb C[PD1]_H1.50 (SEQ ID NO: 249)
EVQLVESGGGLVQPGGSLRLSCAASGFTFSSFGMHWVRQAPGKGLEWVSYISHGSSIIYYADSVKGRFTISRDNAKNSLYLQMNSLRAEDTAVYYC
ARGGRLVWSPDYWGQGTLVTVSS

Figure 43E

>mAb C[PD1]_H1.51 (SEQ ID NO: 250)
EVQLVESGGGLVQPGGSLRLSCAASGFTFS<u>SFGMH</u>WVRQAPGKGLEWVS<u>YISKGSSIIYYADSVKG</u>RFTISRDNAKNSLYLQMNSLRAEDTAVYYCA
R<u>GGRLVWSPDY</u>WGQGTLVTVSS

>mAb C[PD1]_H1.52 (SEQ ID NO: 251)
EVQLVESGGGLVQPGGSLRLSCAASGFTFS<u>SFGMH</u>WVRQAPGKGLEWVS<u>YISYGSSIIYYADSVKG</u>RFTISRDNAKNSLYLQMNSLRAEDTAVYYCA
R<u>GGRLVWSPDY</u>WGQGTLVTVSS

>mAb C[PD1]_H1.53 (SEQ ID NO: 252)
EVQLVESGGGLVQPGGSLRLSCAASGFTFS<u>SFGMH</u>WVRQAPGKGLEWVS<u>YISEGSSIIYYADSVKG</u>RFTISRDNAKNSLYLQMNSLRAEDTAVYYCA
R<u>GGRLVWSPDY</u>WGQGTLVTVSS

>mAb C[PD1]_H1.54 (SEQ ID NO: 253)
EVQLVESGGGLVQPGGSLRLSCAASGFTFS<u>SFGMH</u>WVRQAPGKGLEWVS<u>YISSASSIIYYADSVKG</u>RFTISRDNAKNSLYLQMNSLRAEDTAVYYCA
R<u>GGRLVWSPDY</u>WGQGTLVTVSS

>mAb C[PD1]_H1.55 (SEQ ID NO: 254)
EVQLVESGGGLVQPGGSLRLSCAASGFTFS<u>SFGMH</u>WVRQAPGKGLEWVS<u>YISSSSSIIYYADSVKG</u>RFTISRDNAKNSLYLQMNSLRAEDTAVYYCA
R<u>GGRLVWSPDY</u>WGQGTLVTVSS

>mAb C[PD1]_H1.56 (SEQ ID NO: 255)
EVQLVESGGGLVQPGGSLRLSCAASGFTFS<u>SFGMH</u>WVRQAPGKGLEWVS<u>YISSTSSIIYYADSVKG</u>RFTISRDNAKNSLYLQMNSLRAEDTAVYYCA
R<u>GGRLVWSPDY</u>WGQGTLVTVSS

>mAb C[PD1]_H1.57 (SEQ ID NO: 256)
EVQLVESGGGLVQPGGSLRLSCAASGFTFS<u>SFGMH</u>WVRQAPGKGLEWVS<u>YISSQSSIIYYADSVKG</u>RFTISRDNAKNSLYLQMNSLRAEDTAVYYCA
R<u>GGRLVWSPDY</u>WGQGTLVTVSS

>mAb C[PD1]_H1.58 (SEQ ID NO: 257)
EVQLVESGGGLVQPGGSLRLSCAASGFTFS<u>SFGMH</u>WVRQAPGKGLEWVS<u>YISSHSSIIYYADSVKG</u>RFTISRDNAKNSLYLQMNSLRAEDTAVYYCA
R<u>GGRLVWSPDY</u>WGQGTLVTVSS/

>mAb C[PD1]_H1.59 (SEQ ID NO: 258)
EVQLVESGGGLVQPGGSLRLSCAASGFTFS<u>SFGMH</u>WVRQAPGKGLEWVS<u>YISSKSSIIYYADSVKG</u>RFTISRDNAKNSLYLQMNSLRAEDTAVYYCA
R<u>GGRLVWSPDY</u>WGQGTLVTVSS

>mAb C[PD1]_H1.60 (SEQ ID NO: 259)
EVQLVESGGGLVQPGGSLRLSCAASGFTFS<u>SFGMH</u>WVRQAPGKGLEWVS<u>YISSLSSIIYYADSVKG</u>RFTISRDNAKNSLYLQMNSLRAEDTAVYYCA
R<u>GGRLVWSPDY</u>WGQGTLVTVSS

>mAb C[PD1]_H1.61 (SEQ ID NO: 260)
EVQLVESGGGLVQPGGSLRLSCAASGFTFS<u>SFGMH</u>WVRQAPGKGLEWVS<u>YISSYSSIIYYADSVKG</u>RFTISRDNAKNSLYLQMNSLRAEDTAVYYCA
R<u>GGRLVWSPDY</u>WGQGTLVTVSS

>mAb C[PD1]_H1.62 (SEQ ID NO: 261)
EVQLVESGGGLVQPGGSLRLSCAASGFTFS<u>SFGMH</u>WVRQAPGKGLEWVS<u>YISSGTSIIYYADSVKG</u>RFTISRDNAKNSLYLQMNSLRAEDTAVYYCA
R<u>GGRLVWSPDY</u>WGQGTLVTVSS

>mAb C[PD1]_H1.63 (SEQ ID NO: 262)
EVQLVESGGGLVQPGGSLRLSCAASGFTFS<u>SFGMH</u>WVRQAPGKGLEWVS<u>YISSGASIIYYADSVKG</u>RFTISRDNAKNSLYLQMNSLRAEDTAVYYC
AR<u>GGRLVWSPDY</u>WGQGTLVTVSS

>mAb C[PD1]_H1.64 (SEQ ID NO: 263)
EVQLVESGGGLVQPGGSLRLSCAASGFTFS<u>SFGMH</u>WVRQAPGKGLEWVS<u>YISSGQSIIYYADSVKG</u>RFTISRDNAKNSLYLQMNSLRAEDTAVYYC
AR<u>GGRLVWSPDY</u>WGQGTLVTVSS

Figure 43F

>mAb C[PD1]_H1.65 (SEQ ID NO: 264)
EVQLVESGGGLVQPGGSLRLSCAASGFTFS<u>SFGMH</u>WVRQAPGKGLEWVS<u>YISSGGSIIYYADSVKG</u>RFTISRDNAKNSLYLQMNSLRAEDTAVYYC
AR<u>GGRLVWSPDY</u>WGQGTLVTVSS

>mAb C[PD1]_H1.66 (SEQ ID NO: 265)
EVQLVESGGGLVQPGGSLRLSCAASGFTFS<u>SFGMH</u>WVRQAPGKGLEWVS<u>YISSGVSIIYYADSVKG</u>RFTISRDNAKNSLYLQMNSLRAEDTAVYYC
AR<u>GGRLVWSPDY</u>WGQGTLVTVSS

>mAb C[PD1]_H1.67 (SEQ ID NO: 266)
EVQLVESGGGLVQPGGSLRLSCAASGFTFS<u>SFGMH</u>WVRQAPGKGLEWVS<u>YISSGHSIIYYADSVKG</u>RFTISRDNAKNSLYLQMNSLRAEDTAVYYC
AR<u>GGRLVWSPDY</u>WGQGTLVTVSS

>mAb C[PD1]_H1.68 (SEQ ID NO: 267)
EVQLVESGGGLVQPGGSLRLSCAASGFTFS<u>SFGMH</u>WVRQAPGKGLEWVS<u>YISSGKSIIYYADSVKG</u>RFTISRDNAKNSLYLQMNSLRAEDTAVYYCA
R<u>GGRLVWSPDY</u>WGQGTLVTVSS

>mAb C[PD1]_H1.69 (SEQ ID NO: 268)
EVQLVESGGGLVQPGGSLRLSCAASGFTFS<u>SFGMH</u>WVRQAPGKGLEWVS<u>YISSGYSIIYYADSVKG</u>RFTISRDNAKNSLYLQMNSLRAEDTAVYYCA
R<u>GGRLVWSPDY</u>WGQGTLVTVSS

>mAb C[PD1]_H1.70 (SEQ ID NO: 269)
EVQLVESGGGLVQPGGSLRLSCAASGFTFS<u>SFGMH</u>WVRQAPGKGLEWVS<u>YISSGESIIYYADSVKG</u>RFTISRDNAKNSLYLQMNSLRAEDTAVYYCA
R<u>GGRLVWSPDY</u>WGQGTLVTVSS

>mAb C[PD1]_H1.71 (SEQ ID NO: 270)
EVQLVESGGGLVQPGGSLRLSCAASGFTFS<u>SFGMH</u>WVRQAPGKGLEWVS<u>YISSGSTIIYYADSVKG</u>RFTISRDNAKNSLYLQMNSLRAEDTAVYYCA
R<u>GGRLVWSPDY</u>WGQGTLVTVSS

>mAb C[PD1]_H1.72 (SEQ ID NO: 271)
EVQLVESGGGLVQPGGSLRLSCAASGFTFS<u>SFGMH</u>WVRQAPGKGLEWVS<u>YISSGSAIIYYADSVKG</u>RFTISRDNAKNSLYLQMNSLRAEDTAVYYC
AR<u>GGRLVWSPDY</u>WGQGTLVTVSS

>mAb C[PD1]_H1.73 (SEQ ID NO: 272)
EVQLVESGGGLVQPGGSLRLSCAASGFTFS<u>SFGMH</u>WVRQAPGKGLEWVS<u>YISSGSQIIYYADSVKG</u>RFTISRDNAKNSLYLQMNSLRAEDTAVYYC
AR<u>GGRLVWSPDY</u>WGQGTLVTVSS

>mAb C[PD1]_H1.74 (SEQ ID NO: 273)
EVQLVESGGGLVQPGGSLRLSCAASGFTFS<u>SFGMH</u>WVRQAPGKGLEWVS<u>YISSGSGIIYYADSVKG</u>RFTISRDNAKNSLYLQMNSLRAEDTAVYYC
AR<u>GGRLVWSPDY</u>WGQGTLVTVSS

>mAb C[PD1]_H1.75 (SEQ ID NO: 274)
EVQLVESGGGLVQPGGSLRLSCAASGFTFS<u>SFGMH</u>WVRQAPGKGLEWVS<u>YISSGSVIIYYADSVKG</u>RFTISRDNAKNSLYLQMNSLRAEDTAVYYC
AR<u>GGRLVWSPDY</u>WGQGTLVTVSS

>mAb C[PD1]_H1.76 (SEQ ID NO: 275)
EVQLVESGGGLVQPGGSLRLSCAASGFTFS<u>SFGMH</u>WVRQAPGKGLEWVS<u>YISSGSHIIYYADSVKG</u>RFTISRDNAKNSLYLQMNSLRAEDTAVYYC
AR<u>GGRLVWSPDY</u>WGQGTLVTVSS

>mAb C[PD1]_H1.77 (SEQ ID NO: 276)
EVQLVESGGGLVQPGGSLRLSCAASGFTFS<u>SFGMH</u>WVRQAPGKGLEWVS<u>YISSGSDIIYYADSVKG</u>RFTISRDNAKNSLYLQMNSLRAEDTAVYYC
AR<u>GGRLVWSPDY</u>WGQGTLVTVSS

>mAb C[PD1]_H1.78 (SEQ ID NO: 277)
EVQLVESGGGLVQPGGSLRLSCAASGFTFS<u>SFGMH</u>WVRQAPGKGLEWVS<u>YISSGSKIIYYADSVKG</u>RFTISRDNAKNSLYLQMNSLRAEDTAVYYCA
R<u>GGRLVWSPDY</u>WGQGTLVTVSS

Figure 43G

>mAb C[PD1]_H1.79 (SEQ ID NO: 278)
EVQLVESGGGLVQPGGSLRLSCAASGFTFS<u>SFGMH</u>WVRQAPGKGLEWVS<u>YISSGSYIYYADSVK</u>GRFTISRDNAKNSLYLQMNSLRAEDTAVYYCA
R<u>GGRLVWSPDY</u>WGQGTLVTVSS

>mAb C[PD1]_H1.80 (SEQ ID NO: 279)
EVQLVESGGGLVQPGGSLRLSCAASGFTFS<u>SFGMH</u>WVRQAPGKGLEWVS<u>YISSGSSVIYYADSVK</u>GRFTISRDNAKNSLYLQMNSLRAEDTAVYYC
AR<u>GGRLVWSPDY</u>WGQGTLVTVSS

>mAb C[PD1]_H1.81 (SEQ ID NO: 280)
EVQLVESGGGLVQPGGSLRLSCAASGFTFS<u>SFGMH</u>WVRQAPGKGLEWVS<u>YISSGSSLIYYADSVK</u>GRFTISRDNAKNSLYLQMNSLRAEDTAVYYC
AR<u>GGRLVWSPDY</u>WGQGTLVTVSS

>mAb C[PD1]_H1.82 (SEQ ID NO: 281)
EVQLVESGGGLVQPGGSLRLSCAASGFTFS<u>SFGMH</u>WVRQAPGKGLEWVS<u>YISSGSSFIYYADSVK</u>GRFTISRDNAKNSLYLQMNSLRAEDTAVYYC
AR<u>GGRLVWSPDY</u>WGQGTLVTVSS

>mAb C[PD1]_H1.83 (SEQ ID NO: 282)
EVQLVESGGGLVQPGGSLRLSCAASGFTFS<u>SFGMH</u>WVRQAPGKGLEWVS<u>YISSGSSTIYYADSVK</u>GRFTISRDNAKNSLYLQMNSLRAEDTAVYYC
AR<u>GGRLVWSPDY</u>WGQGTLVTVSS/

>mAb C[PD1]_H1.84 (SEQ ID NO: 283)
EVQLVESGGGLVQPGGSLRLSCAASGFTFS<u>SFGMH</u>WVRQAPGKGLEWVS<u>YISSGSSWIYYADSVK</u>GRFTISRDNAKNSLYLQMNSLRAEDTAVYYC
AR<u>GGRLVWSPDY</u>WGQGTLVTVSS/

>mAb C[PD1]_H1.85 (SEQ ID NO: 284)
EVQLVESGGGLVQPGGSLRLSCAASGFTFS<u>SFGMH</u>WVRQAPGKGLEWVS<u>YISSGSSAIYYADSVK</u>GRFTISRDNAKNSLYLQMNSLRAEDTAVYYC
AR<u>GGRLVWSPDY</u>WGQGTLVTVSS

>mAb C[PD1]_H1.86 (SEQ ID NO: 285)
EVQLVESGGGLVQPGGSLRLSCAASGFTFS<u>SFGMH</u>WVRQAPGKGLEWVS<u>YISSGSSNIYYADSVK</u>GRFTISRDNAKNSLYLQMNSLRAEDTAVYYC
AR<u>GGRLVWSPDY</u>WGQGTLVTVSS

>mAb C[PD1]_H1.87 (SEQ ID NO: 286)
EVQLVESGGGLVQPGGSLRLSCAASGFTFS<u>SFGMH</u>WVRQAPGKGLEWVS<u>YISSGSSEIYYADSVK</u>GRFTISRDNAKNSLYLQMNSLRAEDTAVYYC
AR<u>GGRLVWSPDY</u>WGQGTLVTVSS

>mAb C[PD1]_H1.88 (SEQ ID NO: 287)
EVQLVESGGGLVQPGGSLRLSCAASGFTFS<u>SFGMH</u>WVRQAPGKGLEWVS<u>YISSGSSKIYYADSVK</u>GRFTISRDNAKNSLYLQMNSLRAEDTAVYYC
AR<u>GGRLVWSPDY</u>WGQGTLVTVSS

>mAb C[PD1]_H1.89 (SEQ ID NO: 288)
EVQLVESGGGLVQPGGSLRLSCAASGFTFS<u>SFGMH</u>WVRQAPGKGLEWVS<u>YISSGSSIVYYADSVK</u>GRFTISRDNAKNSLYLQMNSLRAEDTAVYYC
AR<u>GGRLVWSPDY</u>WGQGTLVTVSS

>mAb C[PD1]_H1.90 (SEQ ID NO: 289)
EVQLVESGGGLVQPGGSLRLSCAASGFTFS<u>SFGMH</u>WVRQAPGKGLEWVS<u>YISSGSSILYYADSVK</u>GRFTISRDNAKNSLYLQMNSLRAEDTAVYYC
AR<u>GGRLVWSPDY</u>WGQGTLVTVSS

>mAb C[PD1]_H1.91 (SEQ ID NO: 290)
EVQLVESGGGLVQPGGSLRLSCAASGFTFS<u>SFGMH</u>WVRQAPGKGLEWVS<u>YISSGSSIFYYADSVK</u>GRFTISRDNAKNSLYLQMNSLRAEDTAVYYC
AR<u>GGRLVWSPDY</u>WGQGTLVTVSS

Figure 43H

>mAb C[PD1]_H1.92 (SEQ ID NO: 291)
EVQLVESGGGLVQPGGSLRLSCAASGFTFS<u>SFGMH</u>WVRQAPGKGLEWVS<u>YISSGSSITYYADSVKG</u>RFTISRDNAKNSLYLQMNSLRAEDTAVYYC
AR<u>GGRLVWSPDY</u>WGQGTLVTVSS

>mAb C[PD1]_H1.93 (SEQ ID NO: 292)
EVQLVESGGGLVQPGGSLRLSCAASGFTFS<u>SFGMH</u>WVRQAPGKGLEWVS<u>YISSGSSIWYYADSVKG</u>RFTISRDNAKNSLYLQMNSLRAEDTAVYYC
AR<u>GGRLVWSPDY</u>WGQGTLVTVSS

>mAb C[PD1]_H1.94 (SEQ ID NO: 293)
EVQLVESGGGLVQPGGSLRLSCAASGFTFS<u>SFGMH</u>WVRQAPGKGLEWVS<u>YISSGSSIAYYADSVKG</u>RFTISRDNAKNSLYLQMNSLRAEDTAVYYC
AR<u>GGRLVWSPDY</u>WGQGTLVTVSS

>mAb C[PD1]_H1.95 (SEQ ID NO: 294)
EVQLVESGGGLVQPGGSLRLSCAASGFTFS<u>SFGMH</u>WVRQAPGKGLEWVS<u>YISSGSSINYYADSVKG</u>RFTISRDNAKNSLYLQMNSLRAEDTAVYYC
AR<u>GGRLVWSPDY</u>WGQGTLVTVSS

>mAb C[PD1]_H1.96 (SEQ ID NO: 295)
EVQLVESGGGLVQPGGSLRLSCAASGFTFS<u>SFGMH</u>WVRQAPGKGLEWVS<u>YISSGSSIEYYADSVKG</u>RFTISRDNAKNSLYLQMNSLRAEDTAVYYC
AR<u>GGRLVWSPDY</u>WGQGTLVTVSS

>mAb C[PD1]_H1.97 (SEQ ID NO: 296)
EVQLVESGGGLVQPGGSLRLSCAASGFTFS<u>SFGMH</u>WVRQAPGKGLEWVS<u>YISSGSSIKYYADSVKG</u>RFTISRDNAKNSLYLQMNSLRAEDTAVYYC
AR<u>GGRLVWSPDY</u>WGQGTLVTVSS

>mAb C[PD1]_H1.98 (SEQ ID NO: 297)
EVQLVESGGGLVQPGGSLRLSCAASGFTFS<u>SFGMH</u>WVRQAPGKGLEWVS<u>YISSGSSIIFYADSVKG</u>RFTISRDNAKNSLYLQMNSLRAEDTAVYYCA
R<u>GGRLVWSPDY</u>WGQGTLVTVSS

>mAb C[PD1]_H1.99 (SEQ ID NO: 298)
EVQLVESGGGLVQPGGSLRLSCAASGFTFS<u>SFGMH</u>WVRQAPGKGLEWVS<u>YISSGSSIIHYADSVKG</u>RFTISRDNAKNSLYLQMNSLRAEDTAVYYC
AR<u>GGRLVWSPDY</u>WGQGTLVTVSS

>mAb C[PD1]_H1.100 (SEQ ID NO: 299)
EVQLVESGGGLVQPGGSLRLSCAASGFTFS<u>SFGMH</u>WVRQAPGKGLEWVS<u>YISSGSSIILYADSVKG</u>RFTISRDNAKNSLYLQMNSLRAEDTAVYYCA
R<u>GGRLVWSPDY</u>WGQGTLVTVSS

>mAb C[PD1]_H1.101 (SEQ ID NO: 300)
EVQLVESGGGLVQPGGSLRLSCAASGFTFS<u>SFGMH</u>WVRQAPGKGLEWVS<u>YISSGSSIIWYADSVKG</u>RFTISRDNAKNSLYLQMNSLRAEDTAVYYC
AR<u>GGRLVWSPDY</u>WGQGTLVTVSS

>mAb C[PD1]_H1.102 (SEQ ID NO: 301)
EVQLVESGGGLVQPGGSLRLSCAASGFTFS<u>SFGMH</u>WVRQAPGKGLEWVS<u>YISSGSSIIVYADSVKG</u>RFTISRDNAKNSLYLQMNSLRAEDTAVYYC
AR<u>GGRLVWSPDY</u>WGQGTLVTVSS

>mAb C[PD1]_H1.103 (SEQ ID NO: 302)
EVQLVESGGGLVQPGGSLRLSCAASGFTFS<u>SFGMH</u>WVRQAPGKGLEWVS<u>YISSGSSIIAYADSVKG</u>RFTISRDNAKNSLYLQMNSLRAEDTAVYYC
AR<u>GGRLVWSPDY</u>WGQGTLVTVSS

>mAb C[PD1]_H1.104 (SEQ ID NO: 303)
EVQLVESGGGLVQPGGSLRLSCAASGFTFS<u>SFGMH</u>WVRQAPGKGLEWVS<u>YISSGSSIIQYADSVKG</u>RFTISRDNAKNSLYLQMNSLRAEDTAVYYC
AR<u>GGRLVWSPDY</u>WGQGTLVTVSS

>mAb C[PD1]_H1.105 (SEQ ID NO: 304)
EVQLVESGGGLVQPGGSLRLSCAASGFTFS<u>SFGMH</u>WVRQAPGKGLEWVS<u>YISSGSSIIDYADSVKG</u>RFTISRDNAKNSLYLQMNSLRAEDTAVYYC
AR<u>GGRLVWSPDY</u>WGQGTLVTVSS

Figure 43l

>mAb C[PD1]_H1.106 (SEQ ID NO: 305)
EVQLVESGGGLVQPGGSLRLSCAASGFTFS<u>SFGMH</u>WVRQAPGKGLEWVS<u>YISSGSSIIKYADSVKG</u>RFTISRDNAKNSLYLQMNSLRAEDTAVYYCA
R<u>GGRLVWSPDY</u>WGQGTLVTVSS

>mAb C[PD1]_H1.107 (SEQ ID NO: 306)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>AGRLVWSPDY</u>WGQGTLVTVSS

>mAb C[PD1]_H1.108 (SEQ ID NO: 307)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>SGRLVWSPDY</u>WGQGTLVTVSS

>mAb C[PD1]_H1.109 (SEQ ID NO: 308)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>TGRLVWSPDY</u>WGQGTLVTVSS

>mAb C[PD1]_H1.110 (SEQ ID NO: 309)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>QGRLVWSPDY</u>WGQGTLVTVSS

>mAb C[PD1]_H1.111 (SEQ ID NO: 310)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>HGRLVWSPDY</u>WGQGTLVTVSS

>mAb C[PD1]_H1.112 (SEQ ID NO: 311)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>KGRLVWSPDY</u>WGQGTLVTVSS

>mAb C[PD1]_H1.113 (SEQ ID NO: 312)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>LGRLVWSPDY</u>WGQGTLVTVSS

>mAb C[PD1]_H1.114 (SEQ ID NO: 313)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>YGRLVWSPDY</u>WGQGTLVTVSS

>mAb C[PD1]_H1.115 (SEQ ID NO: 314)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>GARLVWSPDY</u>WGQGTLVTVSS

>mAb C[PD1]_H1.116 (SEQ ID NO: 315)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>GSRLVWSPDY</u>WGQGTLVTVSS

>mAb C[PD1]_H1.117 (SEQ ID NO: 316)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>GTRLVWSPDY</u>WGQGTLVTVSS

>mAb C[PD1]_H1.118 (SEQ ID NO: 317)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>GQRLVWSPDY</u>WGQGTLVTVSS

>mAb C[PD1]_H1.119 (SEQ ID NO: 318)
EVQLVESGGGLVQPGGSLRLSCAASGFTFS<u>SFGMH</u>WVRQAPGKGLEWVS<u>YISSGSSIIYYADSVKG</u>RFTISRDNAKNSLYLQMNSLRAEDTAVYYCA
R<u>GHRLVWSPDY</u>WGQGTLVTVSS

Figure 43J

>mAb C[PD1]_H1.120 (SEQ ID NO: 319)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGDRLVWSPDYWGQGTLVTVSS

>mAb C[PD1]_H1.121 (SEQ ID NO: 320)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGKRLVWSPDYWGQGTLVTVSS

>mAb C[PD1]_H1.122 (SEQ ID NO: 321)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGLRLVWSPDYWGQGTLVTVSS

>mAb C[PD1]_H1.123 (SEQ ID NO: 322)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGYRLVWSPDYWGQGTLVTVSS

>mAb C[PD1]_H1.124 (SEQ ID NO: 323)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGKLVWSPDYWGQGTLVTVSS

>mAb C[PD1]_H1.125 (SEQ ID NO: 324)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGELVWSPDYWGQGTLVTVSS

>mAb C[PD1]_H1.126 (SEQ ID NO: 325)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGDLVWSPDYWGQGTLVTVSS

>mAb C[PD1]_H1.127 (SEQ ID NO: 326)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGHLVWSPDYWGQGTLVTVSS

>mAb C[PD1]_H1.128 (SEQ ID NO: 327)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGSLVWSPDYWGQGTLVTVSS

>mAb C[PD1]_H1.129 (SEQ ID NO: 328)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGGLVWSPDYWGQGTLVTVSS

>mAb C[PD1]_H1.130 (SEQ ID NO: 329)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGYLVWSPDYWGQGTLVTVSS

>mAb C[PD1]_H1.131 (SEQ ID NO: 330)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGILVWSPDYWGQGTLVTVSS

>mAb C[PD1]_H1.132 (SEQ ID NO: 331)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGWLVWSPDYWGQGTLVTVSS

>mAb C[PD1]_H1.133 (SEQ ID NO: 332)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRIVWSPDYWGQGTLVTVSS

Figure 43K

>mAb C[PD1]_H1.134 (SEQ ID NO: 333)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRFVWSPDYWGQGTLVTVSS

>mAb C[PD1]_H1.135 (SEQ ID NO: 334)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRVVWSPDYWGQGTLVTVSS

>mAb C[PD1]_H1.136 (SEQ ID NO: 335)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRYVWSPDYWGQGTLVTVSS

>mAb C[PD1]_H1.137 (SEQ ID NO: 336)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRWVWSPDYWGQGTLVTVSS

>mAb C[PD1]_H1.138 (SEQ ID NO: 337)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRDVWSPDYWGQGTLVTVSS

>mAb C[PD1]_H1.139 (SEQ ID NO: 338)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRAVWSPDYWGQGTLVTVSS

>mAb C[PD1]_H1.140 (SEQ ID NO: 339)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRQVWSPDYWGQGTLVTVSS

>mAb C[PD1]_H1.141 (SEQ ID NO: 340)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRKVWSPDYWGQGTLVTVSS

>mAb C[PD1]_H1.142 (SEQ ID NO: 341)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLTWSPDYWGQGTLVTVSS

>mAb C[PD1]_H1.143 (SEQ ID NO: 342)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLIWSPDYWGQGTLVTVSS

>mAb C[PD1]_H1.144 (SEQ ID NO: 343)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLLWSPDYWGQGTLVTVSS

>mAb C[PD1]_H1.145 (SEQ ID NO: 344)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLAWSPDYWGQGTLVTVSS

>mAb C[PD1]_H1.146 (SEQ ID NO: 345)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLYWSPDYWGQGTLVTVSS

>mAb C[PD1]_H1.147 (SEQ ID NO: 346)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLQWSPDYWGQGTLVTVSS

Figure 43L

>mAb C[PD1]_H1.148 (SEQ ID NO: 347)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLWWSPDYWGQGTLVTVSS

>mAb C[PD1]_H1.149 (SEQ ID NO: 348)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLDWSPDYWGQGTLVTVSS

>mAb C[PD1]_H1.150 (SEQ ID NO: 349)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLKWSPDYWGQGTLVTVSS

>mAb C[PD1]_H1.151 (SEQ ID NO: 350)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVFSPDYWGQGTLVTVSS

>mAb C[PD1]_H1.152 (SEQ ID NO: 351)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVLSPDYWGQGTLVTVSS

>mAb C[PD1]_H1.153 (SEQ ID NO: 352)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVYSPDYWGQGTLVTVSS

>mAb C[PD1]_H1.154 (SEQ ID NO: 353)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVISPDYWGQGTLVTVSS

>mAb C[PD1]_H1.155 (SEQ ID NO: 354)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVHSPDYWGQGTLVTVSS

>mAb C[PD1]_H1.156 (SEQ ID NO: 355)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVQSPDYWGQGTLVTVSS

>mAb C[PD1]_H1.157 (SEQ ID NO: 356)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVSSPDYWGQGTLVTVSS

>mAb C[PD1]_H1.158 (SEQ ID NO: 357)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVESPDYWGQGTLVTVSS

>mAb C[PD1]_H1.159 (SEQ ID NO: 358)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVRSPDYWGQGTLVTVSS

>mAb C[PD1]_H1.160 (SEQ ID NO: 359)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVWTPDYWGQGTLVTVSS

>mAb C[PD1]_H1.161 (SEQ ID NO: 360)
EVQLVESGGGLVQPGGSLRLSCAASGFTFSSFGMHWVRQAPGKGLEWVSYISSGSSIYYADSVKGRFTISRDNAKNSLYLQMNSLRAEDTAVYYCA
RGGRLVWAPDYWGQGTLVTVSS

Figure 43M

>mAb C[PD1]_H1.162 (SEQ ID NO: 361)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWQPDYWGQGTLVTVSS

>mAb C[PD1]_H1.163 (SEQ ID NO: 362)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWGPDYWGQGTLVTVSS

>mAb C[PD1]_H1.164 (SEQ ID NO: 363)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWVPDYWGQGTLVTVSS

>mAb C[PD1]_H1.165 (SEQ ID NO: 364)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWHPDYWGQGTLVTVSS

>mAb C[PD1]_H1.166 (SEQ ID NO: 365)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWDPDYWGQGTLVTVSS

>mAb C[PD1]_H1.167 (SEQ ID NO: 366)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWKPDYWGQGTLVTVSS

>mAb C[PD1]_H1.168 (SEQ ID NO: 367)
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCA
RGGRLVWYPDYWGQGTLVTVSS

>mAb C[PD1]_L1.1 (SEQ ID NO: 368)
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.2 (SEQ ID NO: 369)
DIVMTQSPDSLAVSLGERATINCKSSQSLLESGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.3 (SEQ ID NO: 370)
DIVMTQSPDSLAVSLGERATINCKSSQSLLSSGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.4 (SEQ ID NO: 371)
DIVMTQSPDSLAVSLGERATINCKSSQSLLRSGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.5 (SEQ ID NO: 372)
DIVMTQSPDSLAVSLGERATINCKSSQSLLLSGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.6 (SEQ ID NO: 373)
DIVMTQSPDSLAVSLGERATINCKSSQSLLTSGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.7 (SEQ ID NO: 374)
DIVMTQSPDSLAVSLGERATINCKSSQSLLGSGNQKNYLTWYQQKPGQPPKLLIYWASTRESGVPDRFTGSGSGTDFTLTISSLQAEDVAVYYCQND
YSYPFTFGSGTKLEIK

Figure 43N

>mAb C[PD1]_L1.8 (SEQ ID NO: 375)
DIVMTQSPDSLAVSLGERATINCKSSQSLLYSGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.9 (SEQ ID NO: 376)
DIVMTQSPDSLAVSLGERATINCKSSQSLLNTGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.10 (SEQ ID NO: 377)
DIVMTQSPDSLAVSLGERATINCKSSQSLLNAGNQKNYLTWYQQKPGQPPKLLIYWASTRESGVPDRFTGSGSGTDFTLTISSLQAEDVAVYYCQN
DYSYPFTFGSGTKLEIK

>mAb C[PD1]_L1.11 (SEQ ID NO: 378)
DIVMTQSPDSLAVSLGERATINCKSSQSLLNQGNQKNYLTWYQQKPGQPPKLLIYWASTRESGVPDRFTGSGSGTDFTLTISSLQAEDVAVYYCQN
DYSYPFTFGSGTKLEIK

>mAb C[PD1]_L1.12 (SEQ ID NO: 379)
DIVMTQSPDSLAVSLGERATINCKSSQSLLNVGNQKNYLTWYQQKPGQPPKLLIYWASTRESGVPDRFTGSGSGTDFTLTISSLQAEDVAVYYCQN
DYSYPFTFGSGTKLEIK

>mAb C[PD1]_L1.13 (SEQ ID NO: 380)
DIVMTQSPDSLAVSLGERATINCKSSQSLLNHGNQKNYLTWYQQKPGQPPKLLIYWASTRESGVPDRFTGSGSGTDFTLTISSLQAEDVAVYYCQN
DYSYPFTFGSGTKLEIK

>mAb C[PD1]_L1.14 (SEQ ID NO: 381)
DIVMTQSPDSLAVSLGERATINCKSSQSLLNKGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.15 (SEQ ID NO: 382)
DIVMTQSPDSLAVSLGERATINCKSSQSLLNYGNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.16 (SEQ ID NO: 383)
DIVMTQSPDSLAVSLGERATINCKSSQSLLNSANQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.17 (SEQ ID NO: 384)
DIVMTQSPDSLAVSLGERATINCKSSQSLLNSQNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.18 (SEQ ID NO: 385)
DIVMTQSPDSLAVSLGERATINCKSSQSLLNSHNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.19 (SEQ ID NO: 386)
DIVMTQSPDSLAVSLGERATINCKSSQSLLNSDNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.20 (SEQ ID NO: 387)
DIVMTQSPDSLAVSLGERATINCKSSQSLLNSKNQKNYLTWYQQKPGQPPKLLIYWASTRESGVPDRFTGSGSGTDFTLTISSLQAEDVAVYYCQND
YSYPFTFGSGTKLEIK

>mAb C[PD1]_L1.21 (SEQ ID NO: 388)
DIVMTQSPDSLAVSLGERATINCKSSQSLLNSLNQKNYLTWYQQKPGQPPKLLIYWASTRESGVPDRFTGSGSGTDFTLTISSLQAEDVAVYYCQND
YSYPFTFGSGTKLEIK

Figure 43O

>mAb C[PD1]_L1.22 (SEQ ID NO: 389)
DIVMTQSPDSLAVSLGERATINC<u>KSSQSLLNSYNQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.23 (SEQ ID NO: 390)
DIVMTQSPDSLAVSLGERATINC<u>KSSQSLLNSGDQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.24 (SEQ ID NO: 391)
DIVMTQSPDSLAVSLGERATINC<u>KSSQSLLNSGHQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.25 (SEQ ID NO: 392)
DIVMTQSPDSLAVSLGERATINC<u>KSSQSLLNSGEQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.26 (SEQ ID NO: 393)
DIVMTQSPDSLAVSLGERATINC<u>KSSQSLLNSGSQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.27 (SEQ ID NO: 394)
DIVMTQSPDSLAVSLGERATINC<u>KSSQSLLNSGRQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.28 (SEQ ID NO: 395)
DIVMTQSPDSLAVSLGERATINC<u>KSSQSLLNSGLQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.29 (SEQ ID NO: 396)
DIVMTQSPDSLAVSLGERATINC<u>KSSQSLLNSGTQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.30 (SEQ ID NO: 397)
DIVMTQSPDSLAVSLGERATINC<u>KSSQSLLNSGGQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.31 (SEQ ID NO: 398)
DIVMTQSPDSLAVSLGERATINC<u>KSSQSLLNSGYQKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.32 (SEQ ID NO: 399)
DIVMTQSPDSLAVSLGERATINC<u>KSSQSLLNSGNEKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.33 (SEQ ID NO: 400)
DIVMTQSPDSLAVSLGERATINC<u>KSSQSLLNSGNHKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.34 (SEQ ID NO: 401)
DIVMTQSPDSLAVSLGERATINC<u>KSSQSLLNSGNNKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.35 (SEQ ID NO: 402)
DIVMTQSPDSLAVSLGERATINC<u>KSSQSLLNSGNKKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

Figure 43P

>mAb C[PD1]_L1.36 (SEQ ID NO: 403)
DIVMTQSPDSLAVSLGERATINC<u>KSSQSLLNSGNAKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.37 (SEQ ID NO: 404)
DIVMTQSPDSLAVSLGERATINC<u>KSSQSLLNSGNFKNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.38 (SEQ ID NO: 405)
DIVMTQSPDSLAVSLGERATINC<u>KSSQSLLNSGNIKNYLT</u>WYQQKPGQPPKLLIY<u>WASTRES</u>GVPDRFTGSGSGTDFTLTISSLQAEDVAVYYC<u>QNDY
SYPFT</u>FGSGTKLEIK

>mAb C[PD1]_L1.39 (SEQ ID NO: 406)
DIVMTQSPDSLAVSLGERATINC<u>KSSQSLLNSGNQRNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.40 (SEQ ID NO: 407)
DIVMTQSPDSLAVSLGERATINC<u>KSSQSLLNSGNQENYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.41 (SEQ ID NO: 408)
DIVMTQSPDSLAVSLGERATINC<u>KSSQSLLNSGNQHNYLT</u>WYQQKPGQPPKLLIY<u>WASTRES</u>GVPDRFTGSGSGTDFTLTISSLQAEDVAVYYC<u>QN
DYSYPFT</u>FGSGTKLEIK

>mAb C[PD1]_L1.42 (SEQ ID NO: 409)
DIVMTQSPDSLAVSLGERATINC<u>KSSQSLLNSGNQDNYLT</u>WYQQKPGQPPKLLIY<u>WASTRES</u>GVPDRFTGSGSGTDFTLTISSLQAEDVAVYYC<u>QN
DYSYPFT</u>FGSGTKLEIK

>mAb C[PD1]_L1.43 (SEQ ID NO: 410)
DIVMTQSPDSLAVSLGERATINC<u>KSSQSLLNSGNQANYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.44 (SEQ ID NO: 411)
DIVMTQSPDSLAVSLGERATINC<u>KSSQSLLNSGNQGNYLT</u>WYQQKPGQPPKLLIY<u>WASTRES</u>GVPDRFTGSGSGTDFTLTISSLQAEDVAVYYC<u>QN
DYSYPFT</u>FGSGTKLEIK

>mAb C[PD1]_L1.45 (SEQ ID NO: 412)
DIVMTQSPDSLAVSLGERATINC<u>KSSQSLLNSGNQYNYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.46 (SEQ ID NO: 413)
DIVMTQSPDSLAVSLGERATINC<u>KSSQSLLNSGNQINYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.47 (SEQ ID NO: 414)
DIVMTQSPDSLAVSLGERATINC<u>KSSQSLLNSGNQKDYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.48 (SEQ ID NO: 415)
DIVMTQSPDSLAVSLGERATINC<u>KSSQSLLNSGNQKHYLT</u>WYQQKPGQPPKLLIY<u>WASTRES</u>GVPDRFTGSGSGTDFTLTISSLQAEDVAVYYC<u>QND
YSYPFT</u>FGSGTKLEIK

>mAb C[PD1]_L1.49 (SEQ ID NO: 416)
DIVMTQSPDSLAVSLGERATINC<u>KSSQSLLNSGNQKEYLT</u>WYQQKPGQPPKLLIY<u>WASTRES</u>GVPDRFTGSGSGTDFTLTISSLQAEDVAVYYC<u>QND
YSYPFT</u>FGSGTKLEIK

Figure 43Q

>mAb C[PD1]_L1.50 (SEQ ID NO: 417)
DIVMTQSPDSLAVSLGERATINCKSSQSLLNSGNQKSYLTWYQQKPGQPPKLLIYWASTRESGVPDRFTGSGSGTDFTLTISSLQAEDVAVYYCQND
YSYPFTFGSGTKLEIK

>mAb C[PD1]_L1.51 (SEQ ID NO: 418)
DIVMTQSPDSLAVSLGERATINCKSSQSLLNSGNQKRYLTWYQQKPGQPPKLLIYWASTRESGVPDRFTGSGSGTDFTLTISSLQAEDVAVYYCQND
YSYPFTFGSGTKLEIK

>mAb C[PD1]_L1.52 (SEQ ID NO: 419)
DIVMTQSPDSLAVSLGERATINCKSSQSLLNSGNQKLYLTWYQQKPGQPPKLLIYWASTRESGVPDRFTGSGSGTDFTLTISSLQAEDVAVYYCQND
YSYPFTFGSGTKLEIK

>mAb C[PD1]_L1.53 (SEQ ID NO: 420)
DIVMTQSPDSLAVSLGERATINCKSSQSLLNSGNQKTYLTWYQQKPGQPPKLLIYWASTRESGVPDRFTGSGSGTDFTLTISSLQAEDVAVYYCQND
YSYPFTFGSGTKLEIK

>mAb C[PD1]_L1.54 (SEQ ID NO: 421)
DIVMTQSPDSLAVSLGERATINCKSSQSLLNSGNQKGYLTWYQQKPGQPPKLLIYWASTRESGVPDRFTGSGSGTDFTLTISSLQAEDVAVYYCQND
YSYPFTFGSGTKLEIK

>mAb C[PD1]_L1.55 (SEQ ID NO: 422)
DIVMTQSPDSLAVSLGERATINCKSSQSLLNSGNQKYYLTWYQQKPGQPPKLLIYWASTRESGVPDRFTGSGSGTDFTLTISSLQAEDVAVYYCQND
YSYPFTFGSGTKLEIK

>mAb C[PD1]_L1.56 (SEQ ID NO: 423)
DIVMTQSPDSLAVSLGERATINCKSSQSLLNSGNQKNFLTWYQQKPGQPPKLLIYWASTRESGVPDRFTGSGSGTDFTLTISSLQAEDVAVYYCQND
YSYPFTFGSGTKLEIK

>mAb C[PD1]_L1.57 (SEQ ID NO: 424)
DIVMTQSPDSLAVSLGERATINCKSSQSLLNSGNQKNHLTWYQQKPGQPPKLLIYWASTRESGVPDRFTGSGSGTDFTLTISSLQAEDVAVYYCQN
DYSYPFTFGSGTKLEIK

>mAb C[PD1]_L1.58 (SEQ ID NO: 425)
DIVMTQSPDSLAVSLGERATINCKSSQSLLNSGNQKNLLTWYQQKPGQPPKLLIYWASTRESGVPDRFTGSGSGTDFTLTISSLQAEDVAVYYCQND
YSYPFTFGSGTKLEIK

>mAb C[PD1]_L1.59 (SEQ ID NO: 426)
DIVMTQSPDSLAVSLGERATINCKSSQSLLNSGNQKNWLTWYQQKPGQPPKLLIYWASTRESGVPDRFTGSGSGTDFTLTISSLQAEDVAVYYCQN
DYSYPFTFGSGTKLEIK

>mAb C[PD1]_L1.60 (SEQ ID NO: 427)
DIVMTQSPDSLAVSLGERATINCKSSQSLLNSGNQKNVLTWYQQKPGQPPKLLIYWASTRESGVPDRFTGSGSGTDFTLTISSLQAEDVAVYYCQN
DYSYPFTFGSGTKLEIK

>mAb C[PD1]_L1.61 (SEQ ID NO: 428)
DIVMTQSPDSLAVSLGERATINCKSSQSLLNSGNQKNALTWYQQKPGQPPKLLIYWASTRESGVPDRFTGSGSGTDFTLTISSLQAEDVAVYYCQN
DYSYPFTFGSGTKLEIK

>mAb C[PD1]_L1.62 (SEQ ID NO: 429)
DIVMTQSPDSLAVSLGERATINCKSSQSLLNSGNQKNQLTWYQQKPGQPPKLLIYWASTRESGVPDRFTGSGSGTDFTLTISSLQAEDVAVYYCQN
DYSYPFTFGSGTKLEIK

>mAb C[PD1]_L1.63 (SEQ ID NO: 430)
DIVMTQSPDSLAVSLGERATINCKSSQSLLNSGNQKNDLTWYQQKPGQPPKLLIYWASTRESGVPDRFTGSGSGTDFTLTISSLQAEDVAVYYCQN
DYSYPFTFGSGTKLEIK

Figure 43R

>mAb C[PD1]_L1.64 (SEQ ID NO: 431)
DIVMTQSPDSLAVSLGERATINCKSSQSLLNSGNQKNKLTWYQQKPGQPPKLLIYWASTRESGVPDRFTGSGSGTDFTLTISSLQAEDVAVYYCQND
YSYPFTFGSGTKLEIK

>mAb C[PD1]_L1.65 (SEQ ID NO: 432)
DIVMTQSPDSLAVSLGERATINCKSSQSLLNSGNQKNYLAWYQQKPGQPPKLLIYWASTRESGVPDRFTGSGSGTDFTLTISSLQAEDVAVYYCQN
DYSYPFTFGSGTKLEIK

>mAb C[PD1]_L1.66 (SEQ ID NO: 433)
DIVMTQSPDSLAVSLGERATINCKSSQSLLNSGNQKNYLTWYQQKPGQPPKLLIYFASTRESGVPDRFTGSGSGTDFTLTISSLQAEDVAVYYCQNDY
SYPFTFGSGTKLEIK

>mAb C[PD1]_L1.67 (SEQ ID NO: 434)
DIVMTQSPDSLAVSLGERATINCKSSQSLLNSGNQKNYLTWYQQKPGQPPKLLIYLASTRESGVPDRFTGSGSGTDFTLTISSLQAEDVAVYYCQNDY
SYPFTFGSGTKLEIK

>mAb C[PD1]_L1.68 (SEQ ID NO: 435)
DIVMTQSPDSLAVSLGERATINCKSSQSLLNSGNQKNYLTWYQQKPGQPPKLLIYYASTRESGVPDRFTGSGSGTDFTLTISSLQAEDVAVYYCQND
YSYPFTFGSGTKLEIK

>mAb C[PD1]_L1.69 (SEQ ID NO: 436)
DIVMTQSPDSLAVSLGERATINCKSSQSLLNSGNQKNYLTWYQQKPGQPPKLLIYIASTRESGVPDRFTGSGSGTDFTLTISSLQAEDVAVYYCQNDY
SYPFTFGSGTKLEIK

>mAb C[PD1]_L1.70 (SEQ ID NO: 437)
DIVMTQSPDSLAVSLGERATINCKSSQSLLNSGNQKNYLTWYQQKPGQPPKLLIYHASTRESGVPDRFTGSGSGTDFTLTISSLQAEDVAVYYCQND
YSYPFTFGSGTKLEIK

>mAb C[PD1]_L1.71 (SEQ ID NO: 438)
DIVMTQSPDSLAVSLGERATINCKSSQSLLNSGNQKNYLTWYQQKPGQPPKLLIYQASTRESGVPDRFTGSGSGTDFTLTISSLQAEDVAVYYCQND
YSYPFTFGSGTKLEIK

>mAb C[PD1]_L1.72 (SEQ ID NO: 439)
DIVMTQSPDSLAVSLGERATINCKSSQSLLNSGNQKNYLTWYQQKPGQPPKLLIYSASTRESGVPDRFTGSGSGTDFTLTISSLQAEDVAVYYCQNDY
SYPFTFGSGTKLEIK

>mAb C[PD1]_L1.73 (SEQ ID NO: 440)
DIVMTQSPDSLAVSLGERATINCKSSQSLLNSGNQKNYLTWYQQKPGQPPKLLIYDASTRESGVPDRFTGSGSGTDFTLTISSLQAEDVAVYYCQND
YSYPFTFGSGTKLEIK

>mAb C[PD1]_L1.74 (SEQ ID NO: 441)
DIVMTQSPDSLAVSLGERATINCKSSQSLLNSGNQKNYLTWYQQKPGQPPKLLIYRASTRESGVPDRFTGSGSGTDFTLTISSLQAEDVAVYYCQND
YSYPFTFGSGTKLEIK

>mAb C[PD1]_L1.75 (SEQ ID NO: 442)
DIVMTQSPDSLAVSLGERATINCKSSQSLLNSGNQKNYLTWYQQKPGQPPKLLIYWASVRESGVPDRFTGSGSGTDFTLTISSLQAEDVAVYYCQN
DYSYPFTFGSGTKLEIK

>mAb C[PD1]_L1.76 (SEQ ID NO: 443)
DIVMTQSPDSLAVSLGERATINCKSSQSLLNSGNQKNYLTWYQQKPGQPPKLLIYWASSRESGVPDRFTGSGSGTDFTLTISSLQAEDVAVYYCQND
YSYPFTFGSGTKLEIK

>mAb C[PD1]_L1.77 (SEQ ID NO: 444)
DIVMTQSPDSLAVSLGERATINCKSSQSLLNSGNQKNYLTWYQQKPGQPPKLLIYWASARESGVPDRFTGSGSGTDFTLTISSLQAEDVAVYYCQN
DYSYPFTFGSGTKLEIK

Figure 43S

>mAb C[PD1]_L1.78 (SEQ ID NO: 445)
DIVMTQSPDSLAVSLGERATINCKSSQSLLNSGNQKNYLTWYQQKPGQPPKLLIYWASIRESGVPDRFTGSGSGTDFTLTISSLQAEDVAVYYCQND
YSYPFTFGSGTKLEIK

>mAb C[PD1]_L1.79 (SEQ ID NO: 446)
DIVMTQSPDSLAVSLGERATINCKSSQSLLNSGNQKNYLTWYQQKPGQPPKLLIYWASQRESGVPDRFTGSGSGTDFTLTISSLQAEDVAVYYCQN
DYSYPFTFGSGTKLEIK

>mAb C[PD1]_L1.80 (SEQ ID NO: 447)
DIVMTQSPDSLAVSLGERATINCKSSQSLLNSGNQKNYLTWYQQKPGQPPKLLIYWASHRESGVPDRFTGSGSGTDFTLTISSLQAEDVAVYYCQN
DYSYPFTFGSGTKLEIK

>mAb C[PD1]_L1.81 (SEQ ID NO: 448)
DIVMTQSPDSLAVSLGERATINCKSSQSLLNSGNQKNYLTWYQQKPGQPPKLLIYWASDRESGVPDRFTGSGSGTDFTLTISSLQAEDVAVYYCQN
DYSYPFTFGSGTKLEIK

>mAb C[PD1]_L1.82 (SEQ ID NO: 449)
DIVMTQSPDSLAVSLGERATINCKSSQSLLNSGNQKNYLTWYQQKPGQPPKLLIYWASKRESGVPDRFTGSGSGTDFTLTISSLQAEDVAVYYCQND
YSYPFTFGSGTKLEIK

>mAb C[PD1]_L1.83 (SEQ ID NO: 450)
DIVMTQSPDSLAVSLGERATINCKSSQSLLNSGNQKNYLTWYQQKPGQPPKLLIYWASYRESGVPDRFTGSGSGTDFTLTISSLQAEDVAVYYCQND
YSYPFTFGSGTKLEIK

>mAb C[PD1]_L1.84 (SEQ ID NO: 451)
DIVMTQSPDSLAVSLGERATINCKSSQSLLNSGNQKNYLTWYQQKPGQPPKLLIYWASTRQSGVPDRFTGSGSGTDFTLTISSLQAEDVAVYYCQN
DYSYPFTFGSGTKLEIK

>mAb C[PD1]_L1.85 (SEQ ID NO: 452)
DIVMTQSPDSLAVSLGERATINCKSSQSLLNSGNQKNYLTWYQQKPGQPPKLLIYWASTRKSGVPDRFTGSGSGTDFTLTISSLQAEDVAVYYCQND
YSYPFTFGSGTKLEIK

>mAb C[PD1]_L1.86 (SEQ ID NO: 453)
DIVMTQSPDSLAVSLGERATINCKSSQSLLNSGNQKNYLTWYQQKPGQPPKLLIYWASTRSSGVPDRFTGSGSGTDFTLTISSLQAEDVAVYYCQND
YSYPFTFGSGTKLEIK

>mAb C[PD1]_L1.87 (SEQ ID NO: 454)
DIVMTQSPDSLAVSLGERATINCKSSQSLLNSGNQKNYLTWYQQKPGQPPKLLIYWASTRHSGVPDRFTGSGSGTDFTLTISSLQAEDVAVYYCQN
DYSYPFTFGSGTKLEIK

>mAb C[PD1]_L1.88 (SEQ ID NO: 455)
DIVMTQSPDSLAVSLGERATINCKSSQSLLNSGNQKNYLTWYQQKPGQPPKLLIYWASTRASGVPDRFTGSGSGTDFTLTISSLQAEDVAVYYCQN
DYSYPFTFGSGTKLEIK

>mAb C[PD1]_L1.89 (SEQ ID NO: 456)
DIVMTQSPDSLAVSLGERATINCKSSQSLLNSGNQKNYLTWYQQKPGQPPKLLIYWASTRGSGVPDRFTGSGSGTDFTLTISSLQAEDVAVYYCQN
DYSYPFTFGSGTKLEIK

>mAb C[PD1]_L1.90 (SEQ ID NO: 457)
DIVMTQSPDSLAVSLGERATINCKSSQSLLNSGNQKNYLTWYQQKPGQPPKLLIYWASTRFSGVPDRFTGSGSGTDFTLTISSLQAEDVAVYYCQND
YSYPFTFGSGTKLEIK

>mAb C[PD1]_L1.91 (SEQ ID NO: 458)
DIVMTQSPDSLAVSLGERATINCKSSQSLLNSGNQKNYLTWYQQKPGQPPKLLIYWASTRISGVPDRFTGSGSGTDFTLTISSLQAEDVAVYYCQND
YSYPFTFGSGTKLEIK

Figure 43T

>mAb C[PD1]_L1.92 (SEQ ID NO: 459)
DIVMTQSPDSLAVSLGERATINCKSSQSLLNSGNQKNYLTWYQQKPGQPPKLLIYWASTRETGVPDRFTGSGSGTDFTLTISSLQAEDVAVYYCQND
YSYPFTFGSGTKLEIK

>mAb C[PD1]_L1.93 (SEQ ID NO: 460)
DIVMTQSPDSLAVSLGERATINCKSSQSLLNSGNQKNYLTWYQQKPGQPPKLLIYWASTREAGVPDRFTGSGSGTDFTLTISSLQAEDVAVYYCQN
DYSYPFTFGSGTKLEIK

>mAb C[PD1]_L1.94 (SEQ ID NO: 461)
DIVMTQSPDSLAVSLGERATINCKSSQSLLNSGNQKNYLTWYQQKPGQPPKLLIYWASTREQGVPDRFTGSGSGTDFTLTISSLQAEDVAVYYCQN
DYSYPFTFGSGTKLEIK

>mAb C[PD1]_L1.95 (SEQ ID NO: 462)
DIVMTQSPDSLAVSLGERATINCKSSQSLLNSGNQKNYLTWYQQKPGQPPKLLIYWASTREVGVPDRFTGSGSGTDFTLTISSLQAEDVAVYYCQN
DYSYPFTFGSGTKLEIK

>mAb C[PD1]_L1.96 (SEQ ID NO: 463)
DIVMTQSPDSLAVSLGERATINCKSSQSLLNSGNQKNYLTWYQQKPGQPPKLLIYWASTREHGVPDRFTGSGSGTDFTLTISSLQAEDVAVYYCQN
DYSYPFTFGSGTKLEIK

>mAb C[PD1]_L1.97 (SEQ ID NO: 464)
DIVMTQSPDSLAVSLGERATINCKSSQSLLNSGNQKNYLTWYQQKPGQPPKLLIYWASTREKGVPDRFTGSGSGTDFTLTISSLQAEDVAVYYCQND
YSYPFTFGSGTKLEIK

>mAb C[PD1]_L1.98 (SEQ ID NO: 465)
DIVMTQSPDSLAVSLGERATINCKSSQSLLNSGNQKNYLTWYQQKPGQPPKLLIYWASTREYGVPDRFTGSGSGTDFTLTISSLQAEDVAVYYCQND
YSYPFTFGSGTKLEIK

>mAb C[PD1]_L1.99 (SEQ ID NO: 466)
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQND
YSYPFTFGSGTKLEIK

>mAb C[PD1]_L1.100 (SEQ ID NO: 467)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNQ
YSYPFTFGSGTKLEIK

>mAb C[PD1]_L1.101 (SEQ ID NO: 468)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNE
YSYPFTFGSGTKLEIK

>mAb C[PD1]_L1.102 (SEQ ID NO: 469)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNH
YSYPFTFGSGTKLEIK

>mAb C[PD1]_L1.103 (SEQ ID NO: 470)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNS
YSYPFTFGSGTKLEIK

>mAb C[PD1]_L1.104 (SEQ ID NO: 471)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNR
YSYPFTFGSGTKLEIK

>mAb C[PD1]_L1.105 (SEQ ID NO: 472)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNL
YSYPFTFGSGTKLEIK

Figure 43U

>mAb C[PD1]_L1.106 (SEQ ID NO: 473)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QNT
YSYPFT</u>FGSGTKLEIK

>mAb C[PD1]_L1.107 (SEQ ID NO: 474)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QNG
YSYPFT</u>FGSGTKLEIK

>mAb C[PD1]_L1.108 (SEQ ID NO: 475)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QNY
YSYPFT</u>FGSGTKLEIK

>mAb C[PD1]_L1.109 (SEQ ID NO: 476)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
FSYPFT</u>FGSGTKLEIK

>mAb C[PD1]_L1.110 (SEQ ID NO: 477)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
HSYPFT</u>FGSGTKLEIK

>mAb C[PD1]_L1.111 (SEQ ID NO: 478)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
LSYPFT</u>FGSGTKLEIK

>mAb C[PD1]_L1.112 (SEQ ID NO: 479)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
WSYPFT</u>FGSGTKLEIK

>mAb C[PD1]_L1.113 (SEQ ID NO: 480)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
VSYPFT</u>FGSGTKLEIK

>mAb C[PD1]_L1.114 (SEQ ID NO: 481)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
ASYPFT</u>FGSGTKLEIK

>mAb C[PD1]_L1.115 (SEQ ID NO: 482)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
QSYPFT</u>FGSGTKLEIK

>mAb C[PD1]_L1.116 (SEQ ID NO: 483)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
KSYPFT</u>FGSGTKLEIK

>mAb C[PD1]_L1.117 (SEQ ID NO: 484)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
YTYPFT</u>FGSGTKLEIK

>mAb C[PD1]_L1.118 (SEQ ID NO: 485)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
YAYPFT</u>FGSGTKLEIK

>mAb C[PD1]_L1.119 (SEQ ID NO: 486)
DIVMTQSPDSLAVSLGERATINC<u>KSSQSLLNSGNQKNYLT</u>WYQQKPGQPPKLLIY<u>WASTRES</u>GVPDRFTGSGSGTDFTLTISSLQAEDVAVYYC<u>QND
YQYPFT</u>FGSGTKLEIK

Figure 43V

>mAb C[PD1]_L1.120 (SEQ ID NO: 487)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYGYPFT
FGSGTKLEIK

>mAb C[PD1]_L1.121 (SEQ ID NO: 488)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYVYPFT
FGSGTKLEIK

>mAb C[PD1]_L1.122 (SEQ ID NO: 489)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYHYPFT
FGSGTKLEIK

>mAb C[PD1]_L1.123 (SEQ ID NO: 490)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYDYPFT
FGSGTKLEIK

>mAb C[PD1]_L1.124 (SEQ ID NO: 491)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYKYPFT
FGSGTKLEIK

>mAb C[PD1]_L1.125 (SEQ ID NO: 492)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYFYPFT
FGSGTKLEIK

>mAb C[PD1]_L1.126 (SEQ ID NO: 493)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSFPFT
FGSGTKLEIK

>mAb C[PD1]_L1.127 (SEQ ID NO: 494)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSHPFT
FGSGTKLEIK

>mAb C[PD1]_L1.128 (SEQ ID NO: 495)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSLPFT
FGSGTKLEIK

>mAb C[PD1]_L1.129 (SEQ ID NO: 496)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSWPF
TFGSGTKLEIK

>mAb C[PD1]_L1.130 (SEQ ID NO: 497)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSVPFT
FGSGTKLEIK

>mAb C[PD1]_L1.131 (SEQ ID NO: 498)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSAPFT
FGSGTKLEIK

>mAb C[PD1]_L1.132 (SEQ ID NO: 499)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSQPFT
FGSGTKLEIK

>mAb C[PD1]_L1.133 (SEQ ID NO: 500)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSDPFT
FGSGTKLEIK

>mAb C[PD1]_L1.134 (SEQ ID NO: 501)
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSKPFT
FGSGTKLEIK

Figure 43W mAb C[PD-1]_H1 Variable Heavy (SEQ ID NO: 502)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS mAb C[PD-1]_H1.19 Variable Heavy (SEQ ID NO: 503)
EVQLVESGGGLVQPGGSLRLSCAASGFTFSSLGMHWVRQAPGKGLEWVSYISSGSSIIYYADSVKGRFTISRDNAKNSLYLQMNSL
RAEDTAVYYCARGGRLVWSPDYWGQGTLVTVSS mAb C[PD-1]_H1.48 Variable Heavy (SEQ ID NO: 504)
EVQLVESGGGLVQPGGSLRLSCAASGFTFSSFGMHWVRQAPGKGLEWVSYISGGSSIIYYADSVKGRFTISRDNAKNSLYLQMNSL
RAEDTAVYYCARGGRLVWSPDYWGQGTLVTVSS mAb C[PD-1]_H1.125 Variable Heavy (SEQ ID NO: 505)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGELVWSPDYWGQGTLVTVSS mAb C[PD-1]_H1.130 Variable Heavy (SEQ ID NO: 506)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGYLVWSPDYWGQGTLVTVSS mAb C[PD-1]_H1.132 Variable Heavy (SEQ ID NO: 507)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGWLVWSPDYWGQGTLVTVSS mAb C[PD-1]_H1.169 Variable Heavy (SEQ ID NO: 508)
EVQLVESGGGLVQPGGSLRLSCAASGFTFSSLGMHWVRQAPGKGLEWVSYISGGSSIIYYADSVKGRFTISRDNAKNSLYLQMNSL
RAEDTAVYYCARGGRLVWSPDYWGQGTLVTVSS mAb C[PD-1]_H1.175 Variable Heavy (SEQ ID NO: 509)
EVQLVESGGGLVQPGGSLRLSCAASGFTFSSLGMHWVRQAPGKGLEWVSYISGGSSIIYYADSVKGRFTISRDNAKNSLYLQMNSL
RAEDTAVYYCARGGWLVWSPDYWGQGTLVTVSS mAb C[PD-1]_H2 Variable Heavy (SEQ ID NO: 510)
EVQLVESGGGLVKPGGSLRLSCAASGFTFSSFGMHWVRQAPGKGLEWVGYISSGSSIIYYADPVKGRFTISRDNSKNTLYLQMNSL
KTEDTAVYYCARGGRLVWSPDYWGQGTLVTVSS mAb C[PD-1]_L1 Variable Light (SEQ ID NO: 511)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK mAb C[PD-1]_L1.1 Variable Light (SEQ ID NO: 512)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK mAb C[PD-1]_L1.3 Variable Light (SEQ ID NO: 513)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK mAb C[PD-1]_L1.45 Variable Light (SEQ ID NO: 514)
DIVMTQSPDSLAVSLGERATINCKSSQSLLNSGNQYNYLTWYQQKPGQPPKLLIYWASTRESGVPDRFTGSGSGTDFTLTISSLQA
EDVAVYYCQNDYSYPFTFGSGTKLEIK

Figure 43X mAb C[PD-1]_L1.117 Variable Light (SEQ ID NO: 515)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYTYPFTFGSGTKLEIK mAb C[PD-1]_L1.129 Variable Light (SEQ ID NO: 516)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSWPFTFGSGTKLEIK mAb C[PD-1]_L1.135 Variable Light (SEQ ID NO: 517)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYSYPFTFGSGTKLEIK mAb C[PD-1]_L1.136 Variable Light (SEQ ID NO: 518)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYTYPFTFGSGTKLEIK mAb C[PD-1]_L1.140 Variable Light (SEQ ID NO: 519)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYTYPFTFGSGTKLEIK mAb C[PD-1]_L2 Variable Light (SEQ ID NO: 520)
DIVMTQSPLSLPVTPGEPASISCRSSQSLLNSGNQKNYLTWYLQKPGQPPQLLIYWASTRESGVPDRFTGSGSGTDFTLKISRVEA
EDVGVYYCQNDYSYPFTFGSGTKLEIK

Figure 45

>XENP28536 mAb C[PD-1]_H1L1_IgG1_PVA_/S267K

XENP28536 Chain 1 - mAb C[PD-1]_H1_IgG1_PVA_/S267K Heavy Chain (SEQ ID NO: 521)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK XENP28536 Chain 2 - mAb C[PD-1]_L1 Light Chain (SEQ ID NO: 522)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP28537 mAb C[PD-1]_H1L2_IgG1_PVA_/S267K XENP28537 Chain 1 - mAb C[PD-1]_H1_IgG1_PVA_/S267K Heavy Chain (SEQ ID NO: 523)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK XENP28537 Chain 2 - mAb C[PD-1]_L2 Light Chain (SEQ ID NO: 524)
DIVMTQSPLSLPVTPGEPASISCRSSQSLLNSGNQKNYLTWYLQKPGQPPQLLIYWASTRESGVPDRFTGSGSGTDFTLKISRVEA
EDVGVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP28538 mAb C[PD-1]_H2L1_IgG1_PVA_/S267K XENP28538 Chain 1 - mAb C[PD-1]_H2_IgG1_PVA_/S267K Heavy Chain (SEQ ID NO: 525)
EVQLVESGGGLVKPGGSLRLSCAASGFTFSSFGMHWVRQAPGKGLEWVGYISSGSSIIYYADPVKGRFTISRDNSKNTLYLQMNSL
KTEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK XENP28538 Chain 2 - mAb C[PD-1]_L1 Light Chain (SEQ ID NO: 526)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP28539 mAb C[PD-1]_H2L2_IgG1_PVA_/S267K XENP28539 Chain 1 - mAb C[PD-1]_H2_IgG1_PVA_/S267K Heavy Chain (SEQ ID NO: 527)
EVQLVESGGGLVKPGGSLRLSCAASGFTFSSFGMHWVRQAPGKGLEWVGYISSGSSIIYYADPVKGRFTISRDNSKNTLYLQMNSL
KTEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK XENP28539 Chain 2 - mAb C[PD-1]_L2 Light Chain (SEQ ID NO: 528)
DIVMTQSPLSLPVTPGEPASISCRSSQSLLNSGNQKNYLTWYLQKPGQPPQLLIYWASTRESGVPDRFTGSGSGTDFTLKISRVEA
EDVGVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 46

| | $K_D$ for Human PD-1 | $K_D$ for Cyno PD-1 |
|---|---|---|
| XENP28536 | 2.40E-08 M | 3.58E-08 M |
| XENP28537 | 3.04E-08 M | 4.2E-08 M |
| XENP28538 | NO BINDING | NO BINDING |
| XENP28539 | NO BINDING | NO BINDING |
| XENP28519 | 1.19E-08 M | NO BINDING |

Figure 47

| | XENP16432 | XENP21461 | chmAb C | PDL1-Fc |
|---|---|---|---|---|
| XENP16432 | 0.0468 | 0.0143 | 0.9248 | 0.1582 |
| XENP21461 | 0.0816 | 0.0301 | 0.8414 | 0.1585 |
| chmAb C | 0.8851 | 0.9078 | 0.0237 | 0.3376 |
| HBS-EP | 1 | 1 | 1 | 1 |
| PDL1-Fc | 0.5418 | 0.5045 | 0.9341 | 0.3162 |

Figure 48A

>XENP28543 human_IL15Ra(sushi)_(GGGGS)5-human_IL15(N4D/N65D;single-chain)-mAb C[PD-1]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 529)
ITCPPPMSVEHADIWVKSYSLYSRERYICNSGFKRKAGTSSLTECVLNKATNVAHWTTPSLKCIR/GGGGSGGGGSGGGGSG
GGGSGGGGS/NWVDVISDLKKIEDLIQSMHIDATLYTESDVHPSCKVTAMKCFLLELQVISLESGDASIHDTVEDLIILANN
SLSSNGNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK

Chain 2 - mAb C[PD-1]_H1_IgG1_PVA_/S267K/S364K/E357Q (SEQ ID NO: 530)
EVQLVESGGGLVQPGGSLRLSCAASGFTFSSFGMHWVRQAPGKGLEWVSYISSGSSIIYYADSVKGRFTISRDNAKNSLYLQ
MNSLRAEDTAVYYCARGGRLVWSPDYWGQGTLVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKVSNK
ALPAPIEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVMHEALHNHYTQKSLSLSPGK

Chain 3 - mAb C[PD-1]_L1 (SEQ ID NO: 531)
DIVMTQSPDSLAVSLGERATINCKSSQSLLNSGNQKNYLTWYQQKPGQPPKLLIYWASTRESGVPDRFTGSGSGTDFTLTIS
SLQAEDVAVYYCQNDYSYPFTFGSGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

>XENP29483 human_IL15Ra(sushi)_(GGGGS)5-human_IL15(D30N/N65D;single-chain)-mAb C[PD-1]_H1L1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 532)
ITCPPPMSVEHADIWVKSYSLYSRERYICNSGFKRKAGTSSLTECVLNKATNVAHWTTPSLKCIR/GGGGSGGGGSGGGGSG
GGGSGGGGS/NWVNVISDLKKIEDLIQSMHIDATLYTESNVHPSCKVTAMKCFLLELQVISLESGDASIHDTVEDLIILANN
SLSSNGNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK

Chain 2 - mAb C[PD-1]_H1_IgG1_PVA_/S267K/S364K/E357Q (SEQ ID NO: 533)
EVQLVESGGGLVQPGGSLRLSCAASGFTFSSFGMHWVRQAPGKGLEWVSYISSGSSIIYYADSVKGRFTISRDNAKNSLYLQ
MNSLRAEDTAVYYCARGGRLVWSPDYWGQGTLVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKVSNK
ALPAPIEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVMHEALHNHYTQKSLSLSPGK

Chain 3 - mAb C[PD-1]_L1 (SEQ ID NO: 534)
DIVMTQSPDSLAVSLGERATINCKSSQSLLNSGNQKNYLTWYQQKPGQPPKLLIYWASTRESGVPDRFTGSGSGTDFTLTIS
SLQAEDVAVYYCQNDYSYPFTFGSGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 48B

>XENP30428 human_IL15Ra(sushi)_(GGGGS)5-human_IL15(D30N/E64Q/N65D;single-chain)-mAb C[PD-1]_H1L1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 535)
ITCPPPMSVEHADIWVKSYSLYSRERYICNSGFKRKAGTSSLTECVLNKATNVAHWTTPSLKCIR/GGGGSGGGGSGGGGSG
GGGSGGGGS/NWVNVISDLKKIEDLIQSMHIDATLYTESNVHPSCKVTAMKCFLLELQVISLESGDASIHDTVQDLIILANN
SLSSNGNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK Chain 2 - mAb C[PD-1]_H1_IgG1_PVA_/S267K/S364K/E357Q (SEQ ID NO: 536)
EVQLVESGGGLVQPGGSLRLSCAASGFTFSSFGMHWVRQAPGKGLEWVSYISSGSSIIYYADSVKGRFTISRDNAKNSLYLQ
MNSLRAEDTAVYYCARGGRLVWSPDYWGQGTLVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKVSNK
ALPAPIEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVMHEALHNHYTQKSLSLSPGK Chain 3 - mAb C[PD-1]_L1 (SEQ ID NO: 537)
DIVMTQSPDSLAVSLGERATINCKSSQSLLNSGNQKNYLTWYQQKPGQPPKLLIYWASTRESGVPDRFTGSGSGTDFTLTIS
SLQAEDVAVYYCQNDYSYPFTFGSGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC >XENP30429 human_IL15Ra(sushi)_(GGGGS)5-human_IL15(D30N/E64Q/N65D;single-chain)-mAb C[PD-1]_H1_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 538)
ITCPPPMSVEHADIWVKSYSLYSRERYICNSGFKRKAGTSSLTECVLNKATNVAHWTTPSLKCIR/GGGGSGGGGSGGGGSG
GGGSGGGGS/NWVNVISDLKKIEDLIQSMHIDATLYTESNVHPSCKVTAMKCFLLELQVISLESGDASIHDTVQDLIILANN
SLSSNGNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK Chain 2 - mAb C[PD-1]_H1_IgG1_PVA_/S267K/S364K/E357Q (SEQ ID NO: 539)
EVQLVESGGGLVQPGGSLRLSCAASGFTFSSFGMHWVRQAPGKGLEWVSYISSGSSIIYYADSVKGRFTISRDNAKNSLYLQ
MNSLRAEDTAVYYCARGGRLVWSPDYWGQGTLVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKVSNK
ALPAPIEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVMHEALHNHYTQKSLSLSPGK Chain 3 - mAb C[PD-1]_L1.1 (SEQ ID NO: 540)
DIVMTQSPDSLAVSLGERATINCKSSQSLLHSGNQKNYLTWYQQKPGQPPKLLIYWASTRESGVPDRFTGSGSGTDFTLTIS
SLQAEDVAVYYCQNDYSYPFTFGSGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 48C

>XENP30430 human_IL15Ra(sushi)_(GGGGS)5-human_IL15(D30N/E64Q/N65D;single-chain)-mAb C[PD-1]_H1_L1.3_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 541)
ITCPPPMSVEHADIWVKSYSLYSRERYICNSGFKRKAGTSSLTECVLNKATNVAHWTTPSLKCIR/GGGGSGGGGSGGGGSG
GGGSGGGGS/NWVNVISDLKKIEDLIQSMHIDATLYTESNVHPSCKVTAMKCFLLELQVISLESGDASIHDTVQDLIILANN
SLSSNGNVTESGCKECEELEEKNIKEFLQSFVHIVQMFINTS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTIS
KAKGQPREPQVYTLPPSREEMTKNQVSLTCDVSGFYPSDIAVEWESDGQPENNYKTTPPVLDSDGSFFLYSKLTVDKSRWEQ
GDVFSCSVMHEALHNHYTQKSLSLSPGK

Chain 2 - mAb C[PD-1]_H1_IgG1_PVA_/S267K/S364K/E357Q (SEQ ID NO: 542)
EVQLVESGGGLVQPGGSLRLSCAASGFTFSSFGMHWVRQAPGKGLEWVSYISSGSSIIYYADSVKGRFTISRDNAKNSLYLQ
MNSLRAEDTAVYYCARGGRLVWSPDYWGQGTLVTVSS/ASTKGPSVFPLAPSSKSTSGGTAALGCLVKDYFPEPVTVSWNSG
ALTSGVHTFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKVSNK
ALPAPIEKTISKAKGQPREPQVYTLPPSREQMTKNQVKLTCLVKGFYPSDIAVEWESNGQPENNYKTTPPVLDSDGSFFLYS
KLTVDKSRWQQGNVFSCSVMHEALHNHYTQKSLSLSPGK

Chain 3 - mAb C[PD-1]_L1.3 (SEQ ID NO: 543)
DIVMTQSPDSLAVSLGERATINCKSSQSLLSSGNQKNYLTWYQQKPGQPPKLLIYWASTRESGVPDRFTGSGSGTDFTLTIS
SLQAEDVAVYYCQNDYSYPFTFGSGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 49A

>XENP29439 human_IL15Ra(sushi)_(GGGGS)5-human_IL15(N4D/N65D;single-chain)-mAb C[PD-1]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S/M428L/N434S (SEQ ID NO: 544)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 545)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1 (SEQ ID NO: 546)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30302 human_IL15Ra(sushi)_(GGGGS)5-human_IL15(D30N/N65D;single-chain)-mAb C[PD-1]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S/M428L/N434S (SEQ ID NO: 547)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 548)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1 (SEQ ID NO: 549)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 49B

>XENP30519 human_IL15Ra(sushi)_(GGGGS)5-human_IL15(D30N/E64Q/N65D;single-chain)-mAb C[PD-1]_H1L1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 550)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVNVISDLKKIEDLIQSMHIDATLYTESNVHPSCKVTAMKCFLLELQVISLESGDASIHDTVQDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 551)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1 (SEQ ID NO: 552)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30516 human_IL15Ra(sushi)_(GGGGS)5-human_IL15(D30N/E64Q/N65D;single-chain)-mAb C[PD-1]_H1_L1.1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 553)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVNVISDLKKIEDLIQSMHIDATLYTESNVHPSCKVTAMKCFLLELQVISLESGDASIHDTVQDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 554)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1.1 (SEQ ID NO: 555)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 49C

>XENP30517 human_IL15Ra(sushi)_(GGGGS)5-human_IL15(D30N/E64Q/N65D;single-chain)-mAb C[PD-1]_H1_L1.3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 556)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVNVISDLKKIEDLIQSMHIDATLYTESNVHPSCKVTAMKCFLLELQVISLESGDASIHDTVQDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 557)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1.3 (SEQ ID NO: 558)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC Figure 50
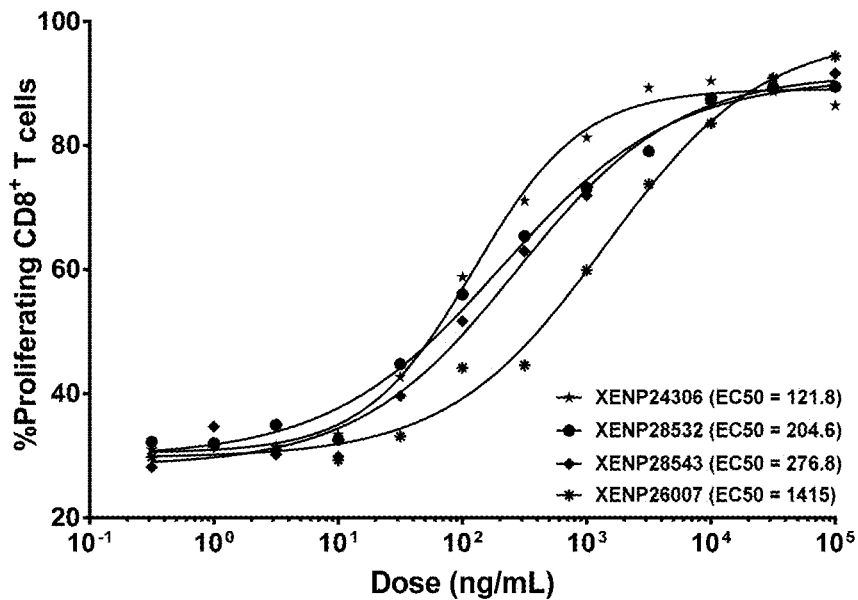
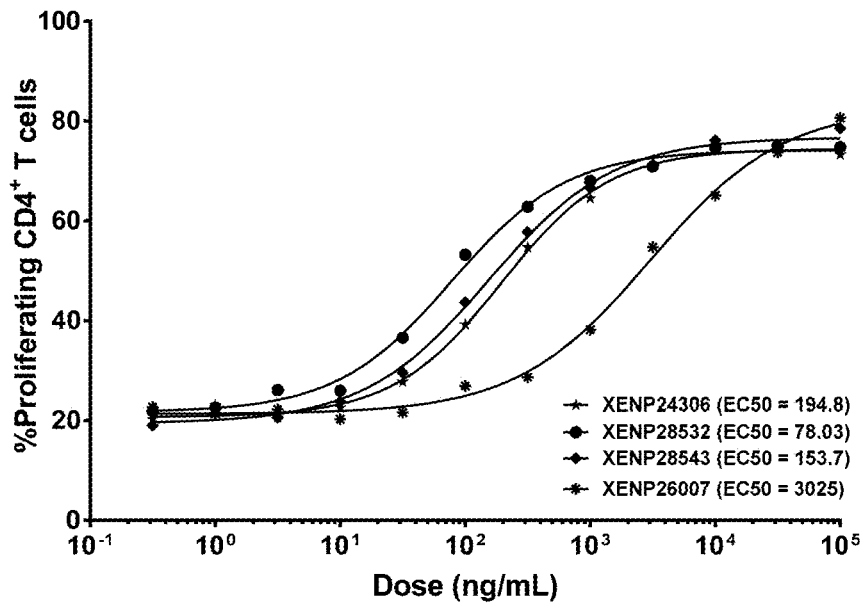

Figure 53
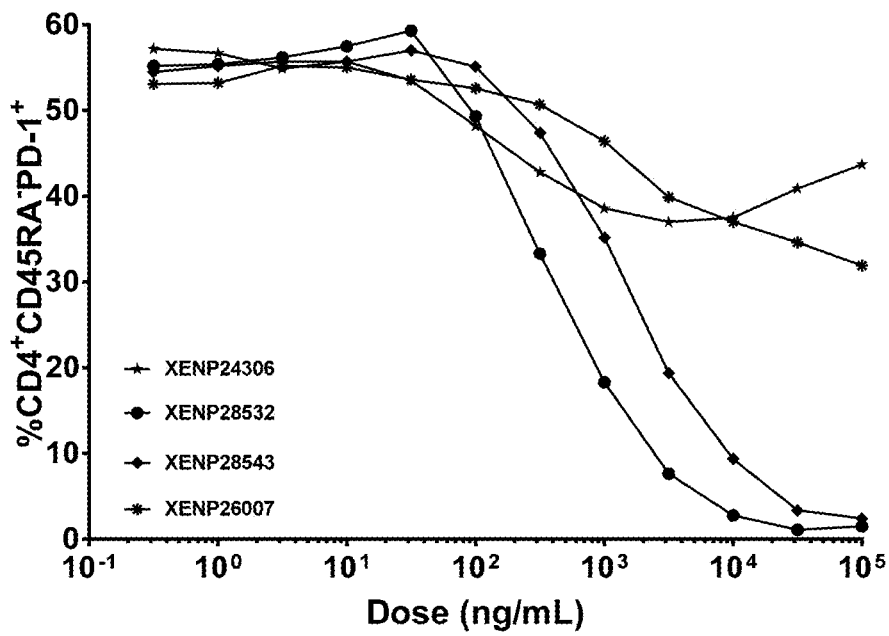
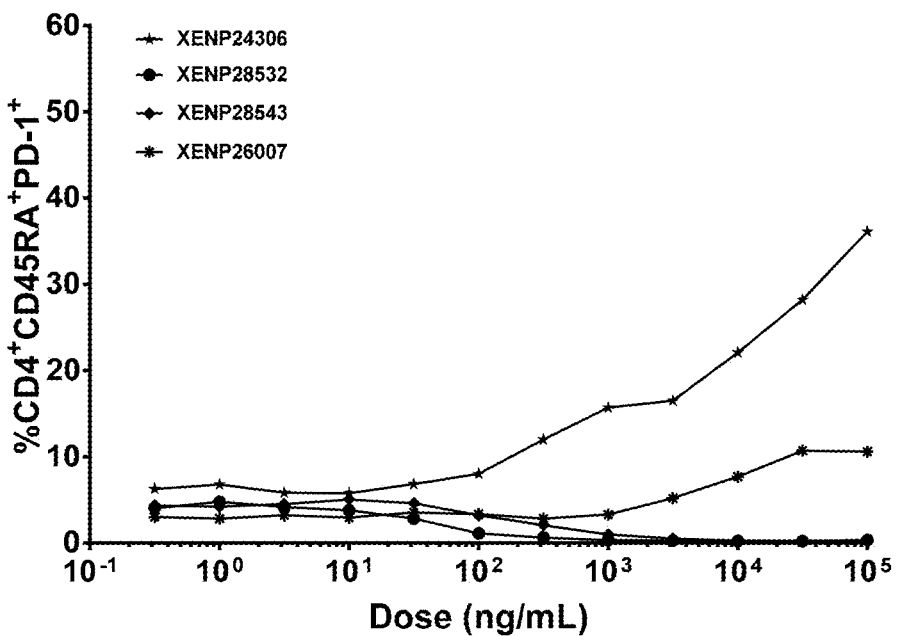

Figure 62
A)
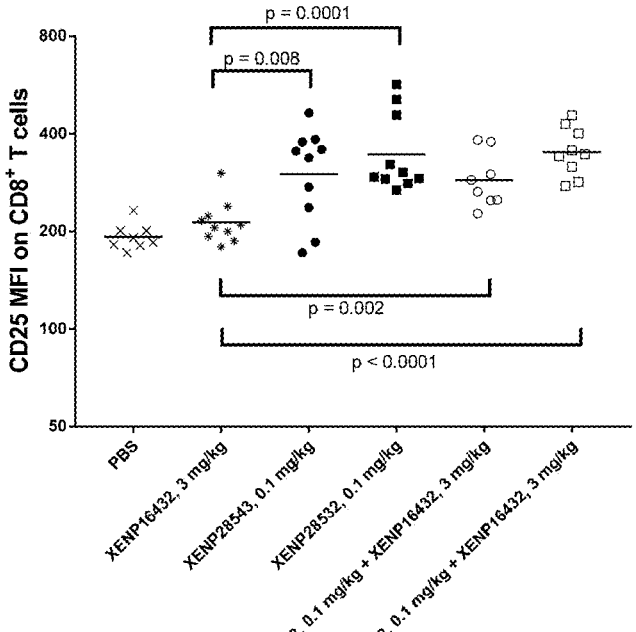
B)
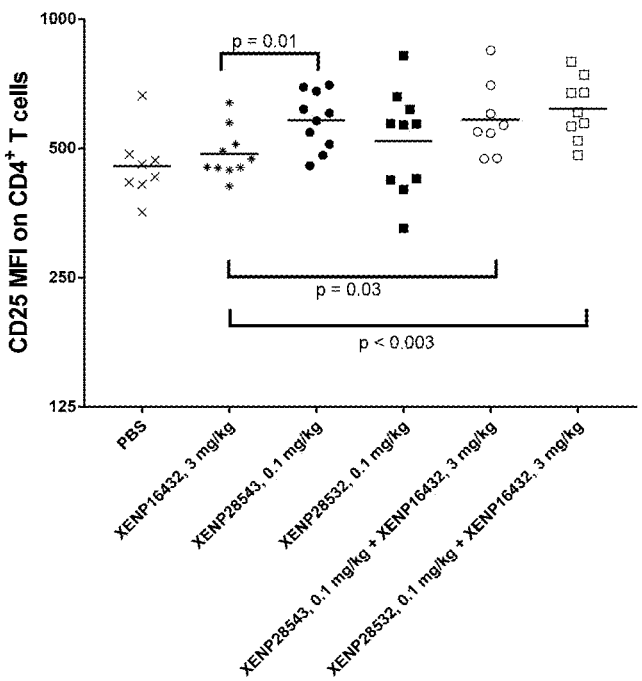

Figure 64

>XENP29724 mAb C[PD1]_H1_L1.1_IgG1_PVA_/S267K

Heavy Chain - mAb C[PD1]_H1_IgG1_PVA_/S267K (SEQ ID NO: 559)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK

Light Chain - mAb C[PD1]_L1.1 (SEQ ID NO: 560)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

>XENP29726 mAb C[PD1]_H1_L1.3_IgG1_PVA_/S267K

Heavy Chain - mAb C[PD1]_H1_IgG1_PVA_/S267K (SEQ ID NO: 561)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK

Light Chain - mAb C[PD1]_L1.3 (SEQ ID NO: 562)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

>XENP29768 mAb C[PD1]_H1_L1.45_IgG1_PVA_/S267K

Heavy Chain - mAb C[PD1]_H1_IgG1_PVA_/S267K (SEQ ID NO: 563)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK

Light Chain - mAb C[PD1]_L1.45 (SEQ ID NO: 564)
DIVMTQSPDSLAVSLGERATINCKSSQSLLNSGNQYNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

>XENP29840 mAb C[PD1]_H1_L1.117_IgG1_PVA_/S267K

Heavy Chain - mAb C[PD1]_H1_IgG1_PVA_/S267K (SEQ ID NO: 565)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLTVDKSRWQQGNVFSCSVM
HEALHNHYTQKSLSLSPGK

Light Chain - mAb C[PD1]_L1.117 (SEQ ID NO: 566)
DIVMTQSPDSLAVSLGERATINCKSSQSLLNSGNQKNYLTWYQQKPGQPPKLLIYWASTRESGVPDRFTGSGSGTDFTLTISSLQA
EDVAVYYCQNDYTYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 65A

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1L1 | WT | | 3.82E-08 | 1.12E+05 | 4.28E-03 | 1.00 |
| H1.1_L1 | VH-S30T | 30T | 3.21E-08 | 1.27E+05 | 4.07E-03 | 1.19 |
| H1.2_L1 | VH-S30A | 30A | 3.56E-08 | 1.21E+05 | 4.32E-03 | 1.07 |
| H1.3_L1 | VH-S30Q | 30Q | 4.00E-08 | 1.18E+05 | 4.72E-03 | 0.96 |
| H1.4_L1 | VH-S30G | 30G | 3.40E-08 | 1.24E+05 | 4.22E-03 | 1.12 |
| H1.5_L1 | VH-S30V | 30V | 3.74E-08 | 1.27E+05 | 4.75E-03 | 1.02 |
| H1.6_L1 | VH-S30H | 30H | 4.85E-08 | 1.09E+05 | 5.29E-03 | 0.79 |
| H1.7_L1 | VH-S30K | 30K | 5.25E-08 | 1.04E+05 | 5.45E-03 | 0.73 |
| H1.8_L1 | VH-S30Y | 30Y | 5.13E-08 | 1.04E+05 | 5.34E-03 | 0.74 |
| H1.9_L1 | VH-S31T | 31T | 4.69E-08 | 1.21E+05 | 5.67E-03 | 0.81 |
| H1.10_L1 | VH-S31A | 31A | 3.69E-08 | 1.15E+05 | 4.25E-03 | 1.03 |
| H1.11_L1 | VH-S31Q | 31Q | 3.68E-08 | 1.23E+05 | 4.54E-03 | 1.04 |
| H1.12_L1 | VH-S31G | 31G | 4.42E-08 | 1.22E+05 | 5.37E-03 | 0.87 |
| H1.13_L1 | VH-S31V | 31V | 5.02E-08 | 1.26E+05 | 6.34E-03 | 0.76 |
| H1.14_L1 | VH-S31H | 31H | 4.58E-08 | 1.19E+05 | 5.46E-03 | 0.83 |
| H1.15_L1 | VH-S31D | 31D | 4.00E-08 | 1.39E+05 | 5.57E-03 | 0.95 |
| H1.16_L1 | VH-S31K | 31K | 4.71E-08 | 1.09E+05 | 5.14E-03 | 0.81 |
| H1.17_L1 | VH-S31Y | 31Y | 5.04E-08 | 1.06E+05 | 5.34E-03 | 0.76 |
| H1.18_L1 | VH-F34Y | 32Y | 4.79E-08 | 1.25E+05 | 5.97E-03 | 0.80 |
| H1.19_L1 | VH-F34L | 32L | 1.67E-08 | 1.30E+05 | 2.17E-03 | 2.29 |
| H1.20_L1 | VH-F34W | 32W | 1.62E-07 | 1.26E+05 | 2.04E-02 | 0.24 |
| H1.21_L1 | VH-F34I | 32I | 2.72E-08 | 1.37E+05 | 3.71E-03 | 1.41 |
| H1.22_L1 | VH-F34H | 32H | 3.40E-08 | 1.05E+05 | 3.58E-03 | 1.12 |
| H1.23_L1 | VH-F34Q | 32Q | 7.34E-08 | 1.18E+05 | 8.63E-03 | 0.52 |
| H1.24_L1 | VH-F34S | 32S | 5.49E-08 | 1.25E+05 | 6.88E-03 | 0.70 |
| H1.25_L1 | VH-F34K | 32K | 1.13E-07 | 1.07E+05 | 1.20E-02 | 0.34 |
| H1.26_L1 | VH-G35A | 33A | 1.93E-07 | 1.87E+05 | 3.60E-02 | 0.20 |
| H1.27_L1 | VH-G35S | 33S | 1.04E-07 | 1.37E+05 | 1.42E-02 | 0.37 |
| H1.28_L1 | VH-G35T | 33T | 9.27E-08 | 3.01E+05 | 2.79E-02 | 0.41 |
| H1.29_L1 | VH-G35N | 33N | 2.23E-07 | 1.96E+05 | 4.37E-02 | 0.17 |
| H1.30_L1 | VH-G35H | 33H | 7.64E-08 | 3.37E+05 | 2.57E-02 | 0.50 |
| H1.31_L1 | VH-G35D | 33D | 5.64E-08 | 7.11E+05 | 4.01E-02 | 0.68 |
| H1.32_L1 | VH-G35K | 33K | N/A | | | N/A |
| H1.33_L1 | VH-G35L | 33L | N/A | | | N/A |
| H1.34_L1 | VH-G35Y | 33Y | N/A | | | N/A |
| H1.35_L1 | VH-H37N | 35N | N/A | | | N/A |
| H1.36_L1 | VH-S54T | 52T | 3.74E-07 | 1.23E+05 | 4.60E-02 | 0.10 |

Figure 65B

| mAb C[PD-1] Variant Description | Substitution (Xencor #) | Kabat Position | $K_D$ (M) | $k_a$ (1/Ms) | $k_a$ (1/s) | Fold improvement over WT |
|---|---|---|---|---|---|---|
| H1.37_L1 | VH-S54A | 52A | 5.60E-08 | 1.36E+05 | 7.63E-03 | 0.68 |
| H1.38_L1 | VH-S54Q | 52Q | 5.75E-08 | 1.35E+05 | 7.76E-03 | 0.66 |
| H1.39_L1 | VH-S54G | 52G | 1.15E-07 | 1.54E+05 | 1.78E-02 | 0.33 |
| H1.40_L1 | VH-S54V | 52V | 2.31E-07 | 1.27E+05 | 2.93E-02 | 0.17 |
| H1.41_L1 | VH-S54H | 52H | 7.46E-08 | 1.40E+05 | 1.04E-02 | 0.51 |
| H1.42_L1 | VH-S54K | 52K | 5.00E-07 | 5.30E+04 | 2.65E-02 | 0.08 |
| H1.43_L1 | VH-S54Y | 52Y | 6.65E-07 | 2.23E+05 | 1.48E-01 | 0.06 |
| H1.44_L1 | VH-S54E | 52E | 1.83E-07 | 1.23E+05 | 2.25E-02 | 0.21 |
| H1.45_L1 | VH-S55T | 52aT | 7.45E-08 | 1.22E+05 | 9.10E-03 | 0.51 |
| H1.46_L1 | VH-S55A | 52aA | 4.19E-08 | 1.26E+05 | 5.29E-03 | 0.91 |
| H1.47_L1 | VH-S55Q | 52aQ | 1.17E-07 | 1.36E+05 | 1.59E-02 | 0.33 |
| H1.48_L1 | VH-S55G | 52aG | 2.01E-08 | 1.46E+05 | 2.93E-03 | 1.90 |
| H1.49_L1 | VH-S55V | 52aV | 9.28E-08 | 1.47E+05 | 1.36E-02 | 0.41 |
| H1.50_L1 | VH-S55H | 52aH | 2.42E-08 | 1.19E+05 | 2.87E-03 | 1.58 |
| H1.51_L1 | VH-S55K | 52aK | 5.49E-08 | 1.03E+05 | 5.67E-03 | 0.70 |
| H1.52_L1 | VH-S55Y | 52aY | 3.31E-08 | 1.28E+05 | 4.23E-03 | 1.15 |
| H1.53_L1 | VH-S55E | 52aE | 9.60E-08 | 2.95E+05 | 2.83E-02 | 0.40 |
| H1.54_L1 | VH-G56A | 53A | 3.45E-08 | 1.25E+05 | 4.32E-03 | 1.11 |
| H1.55_L1 | VH-G56S | 53S | 3.39E-08 | 1.35E+05 | 4.57E-03 | 1.13 |
| H1.56_L1 | VH-G56T | 53T | 3.15E-08 | 1.29E+05 | 4.07E-03 | 1.21 |
| H1.57_L1 | VH-G56Q | 53Q | 3.09E-08 | 1.50E+05 | 4.64E-03 | 1.24 |
| H1.58_L1 | VH-G56H | 53 | 4.39E-08 | 1.24E+05 | 5.44E-03 | 0.87 |
| H1.59_L1 | VH-G56K | 53 | 3.76E-08 | 1.31E+05 | 4.94E-03 | 1.02 |
| H1.60_L1 | VH-G56L | 53 | 3.59E-08 | 1.28E+05 | 4.58E-03 | 1.06 |
| H1.61_L1 | VH-G56Y | 53 | 4.15E-08 | 1.38E+05 | 5.74E-03 | 0.92 |
| H1.62_L1 | VH-S59T | 54 | 5.99E-08 | 1.29E+05 | 7.74E-03 | 0.64 |
| H1.63_L1 | VH-S59A | 54 | 4.24E-08 | 1.46E+05 | 6.19E-03 | 0.90 |
| H1.64_L1 | VH-S59Q | 54 | 5.91E-08 | 1.32E+05 | 7.83E-03 | 0.65 |
| H1.65_L1 | VH-S59G | 54 | 6.10E-08 | 1.36E+05 | 8.27E-03 | 0.63 |
| H1.66_L1 | VH-S59V | 54 | 1.12E-07 | 1.15E+05 | 1.29E-02 | 0.34 |
| H1.67_L1 | VH-S59H | 54 | 4.92E-08 | 1.41E+05 | 6.92E-03 | 0.78 |
| H1.68_L1 | VH-S59K | 54 | 7.40E-08 | 1.09E+05 | 8.08E-03 | 0.52 |
| H1.69_L1 | VH-S59Y | 54 | 5.96E-08 | 1.37E+05 | 8.18E-03 | 0.64 |
| H1.70_L1 | VH-S59E | 54 | 4.80E-08 | 1.40E+05 | 6.74E-03 | 0.80 |
| H1.71_L1 | VH-S60T | 55 | 4.58E-08 | 1.10E+05 | 5.05E-03 | 0.83 |
| H1.72_L1 | VH-S60A | 55 | 6.247E-08 | 1.12E+05 | 7.01E-03 | 0.61 |
| H1L1 | WT | | 4.07E-08 | 1.49E+05 | 6.05E-03 | 1.00 |

Figure 65C

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1.73_L1 | VH-S60Q | 55 | 2.827E-08 | 1.30E+05 | 3.67E-03 | 1.44 |
| H1.74_L1 | VH-S60G | 55 | 5.701E-08 | 1.65E+05 | 9.40E-03 | 0.71 |
| H1.75_L1 | VH-S60V | 55 | 5.258E-08 | 1.52E+05 | 8.01E-03 | 0.77 |
| H1.76_L1 | VH-S60H | 55 | 5.088E-08 | 1.50E+05 | 7.61E-03 | 0.80 |
| H1.77_L1 | VH-S60D | 55 | 3.59E-08 | 1.52E+05 | 5.46E-03 | 1.13 |
| H1.78_L1 | VH-S60K | 55 | 1.744E-07 | 1.34E+05 | 2.33E-02 | 0.23 |
| H1.79_L1 | VH-S60Y | 55 | 4.342E-08 | 1.58E+05 | 6.86E-03 | 0.94 |
| H1.80_L1 | VH-I61V | 56 | 2.066E-07 | 2.26E+05 | 4.66E-02 | 0.20 |
| H1.81_L1 | VH-I61L | 56 | N/A | | | N/A |
| H1.82_L1 | VH-I61F | 56 | N/A | | | N/A |
| H1.83_L1 | VH-I61T | 56 | N/A | | | N/A |
| H1.84_L1 | VH-I61W | 56 | N/A | | | N/A |
| H1.85_L1 | VH-I61A | 56 | 1.323E-07 | 4.67E+05 | 6.18E-02 | 0.31 |
| H1.86_L1 | VH-I61N | 56 | N/A | | | N/A |
| H1.87_L1 | VH-I61E | 56 | N/A | | | N/A |
| H1.88_L1 | VH-I61K | 56 | N/A | | | N/A |
| H1.89_L1 | VH-I62V | 57 | 4.317E-08 | 1.55E+05 | 6.69E-03 | 0.94 |
| H1.90_L1 | VH-I62L | 57 | 5.149E-08 | 1.41E+05 | 7.27E-03 | 0.79 |
| H1.91_L1 | VH-I62F | 57 | 6.1E-08 | 1.50E+05 | 9.17E-03 | 0.67 |
| H1.92_L1 | VH-I62T | 57 | 4.777E-08 | 1.78E+05 | 8.51E-03 | 0.85 |
| H1.93_L1 | VH-I62W | 57 | 3.104E-08 | 1.70E+05 | 5.28E-03 | 1.31 |
| H1.94_L1 | VH-I62A | 57 | 8.06E-08 | 2.00E+05 | 1.61E-02 | 0.50 |
| H1.95_L1 | VH-I62N | 57 | 7.339E-08 | 1.62E+05 | 1.19E-02 | 0.55 |
| H1.96_L1 | VH-I62E | 57 | 4.157E-08 | 1.81E+05 | 7.51E-03 | 0.98 |
| H1.97_L1 | VH-I62K | 57 | 1.135E-07 | 1.54E+05 | 1.75E-02 | 0.36 |
| H1.98_L1 | VH-Y63F | 58 | N/A | | | N/A |
| H1.99_L1 | VH-Y63H | 58 | 2.609E-07 | 2.50E+05 | 6.51E-02 | 0.16 |
| H1.100_L1 | VH-Y63L | 58 | N/A | | | N/A |
| H1.101_L1 | VH-Y63W | 58 | N/A | | | N/A |
| H1.102_L1 | VH-Y63V | 58 | N/A | | | N/A |
| H1.103_L1 | VH-Y63A | 58 | N/A | | | N/A |
| H1.104_L1 | VH-Y63Q | 58 | 4.113E-07 | 1.24E+06 | 5.11E-01 | 0.10 |
| H1.105_L1 | VH-Y63D | 58 | 5.102E-07 | 4.97E+05 | 2.54E-01 | 0.08 |
| H1.106_L1 | VH-Y63K | 58 | N/A | | | N/A |
| H1.107_L1 | VH-G103A | 95 | N/A | | | N/A |
| H1.108_L1 | VH-G103S | 95 | 2.066E-07 | 1.70E+05 | 3.51E-02 | 0.20 |
| H1.109_L1 | VH-G103T | 95 | N/A | | | N/A |

Figure 65D

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1.110_L1 | VH-G103Q | 95 | N/A | | | N/A |
| H1.111_L1 | VH-G103H | 95 | N/A | | | N/A |
| H1.112_L1 | VH-G103K | 95 | N/A | | | N/A |
| H1.113_L1 | VH-G103L | 95 | N/A | | | N/A |
| H1.114_L1 | VH-G103Y | 95 | 5.919E-07 | 1.48E+05 | 8.75E-02 | 0.07 |
| H1.115_L1 | VH-G108A | 96 | 7.674E-08 | 1.51E+05 | 1.16E-02 | 0.53 |
| H1.116_L1 | VH-G108S | 96 | 1.832E-07 | 1.90E+05 | 3.47E-02 | 0.22 |
| H1.117_L1 | VH-G108T | 96 | 1.207E-07 | 8.69E+04 | 1.05E-02 | 0.34 |
| H1.118_L1 | VH-G108Q | 96 | 1.924E-07 | 1.64E+05 | 3.16E-02 | 0.21 |
| H1.119_L1 | VH-G108H | 96 | 1.861E-07 | 2.02E+05 | 3.76E-02 | 0.22 |
| H1.120_L1 | VH-G108D | 96 | N/A | | | N/A |
| H1.121_L1 | VH-G108K | 96 | N/A | | | N/A |
| H1.122_L1 | VH-G108L | 96 | N/A | | | N/A |
| H1.123_L1 | VH-G108Y | 96 | 3.501E-07 | 1.54E+05 | 5.38E-02 | 0.12 |
| H1.124_L1 | VH-R109K | 97 | 4.88E-08 | 1.38E+05 | 6.74E-03 | 0.83 |
| H1.125_L1 | VH-R109E | 97 | 1.872E-08 | 2.78E+05 | 5.20E-03 | 2.17 |
| H1.126_L1 | VH-R109D | 97 | 4.308E-08 | 2.54E+05 | 1.09E-02 | 0.94 |
| H1.127_L1 | VH-R109H | 97 | 3.082E-08 | 1.88E+05 | 5.78E-03 | 1.32 |
| H1.128_L1 | VH-R109S | 97 | 3.275E-08 | 1.86E+05 | 6.08E-03 | 1.24 |
| H1.129_L1 | VH-R109G | 97 | 4.319E-08 | 1.67E+05 | 7.19E-03 | 0.94 |
| H1.130_L1 | VH-R109Y | 97 | 2.215E-08 | 2.28E+05 | 5.05E-03 | 1.84 |
| H1.131_L1 | VH-R109I | 97 | 4.353E-08 | 2.02E+05 | 8.78E-03 | 0.93 |
| H1.132_L1 | VH-R109W | 97 | 9.631E-09 | 2.27E+05 | 2.18E-03 | 4.23 |
| H1.133_L1 | VH-L110I | 98 | 4.947E-08 | 1.52E+05 | 7.53E-03 | 0.82 |
| H1.134_L1 | VH-L110F | 98 | 6.079E-08 | 1.45E+05 | 8.80E-03 | 0.67 |
| H1.135_L1 | VH-L110V | 98 | 4.669E-08 | 1.47E+05 | 6.85E-03 | 0.87 |
| H1.136_L1 | VH-L110Y | 98 | 5.45E-08 | 1.58E+05 | 8.63E-03 | 0.75 |
| H1.137_L1 | VH-L110W | 98 | 3.264E-08 | 1.72E+05 | 5.60E-03 | 1.25 |
| H1.138_L1 | VH-L110D | 98 | 1.162E-07 | 1.10E+05 | 1.28E-02 | 0.35 |
| H1.139_L1 | VH-L110A | 98 | 9.894E-08 | 1.11E+05 | 1.10E-02 | 0.41 |
| H1.140_L1 | VH-L110Q | 98 | N/A | | | N/A |
| H1.141_L1 | VH-L110K | 98 | 1.175E-07 | 1.12E+05 | 1.32E-02 | 0.35 |
| H1.142_L1 | VH-V111T | 99 | 8.796E-08 | 1.34E+05 | 1.18E-02 | 0.46 |
| H1.143_L1 | VH-V111I | 99 | 3.561E-08 | 1.78E+05 | 6.33E-03 | 1.14 |
| H1.144_L1 | VH-V111L | 99 | 1.301E-07 | 1.34E+05 | 1.74E-02 | 0.31 |
| H1.145_L1 | VH-V111A | 99 | 1.099E-07 | 1.61E+05 | 1.77E-02 | 0.37 |
| H1.146_L1 | VH-V111Y | 99 | 1.015E-07 | 1.55E+05 | 1.57E-02 | 0.40 |

Figure 65E

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1.147_L1 | VH-V111Q | 99 | 9.234E-08 | 1.40E+05 | 1.30E-02 | 0.44 |
| H1.148_L1 | VH-V111W | 99 | 7.755E-08 | 1.44E+05 | 1.12E-02 | 0.52 |
| H1.149_L1 | VH-V111D | 99 | 1.163E-07 | 9.97E+04 | 1.16E-02 | 0.35 |
| H1.150_L1 | VH-V111K | 99 | 6.001E-08 | 8.72E+04 | 5.24E-03 | 0.68 |
| H1.151_L1 | VH-W112F | 100 | 3.09E-07 | 2.82E+05 | 8.70E-02 | 0.13 |
| H1.152_L1 | VH-W112L | 100 | 3.01E-07 | 3.26E+05 | 9.81E-02 | 0.14 |
| H1.153_L1 | VH-W112Y | 100 | N/A | | | N/A |
| H1.154_L1 | VH-W112I | 100 | N/A | | | N/A |
| H1.155_L1 | VH-W112H | 100 | N/A | | | N/A |
| H1.156_L1 | VH-W112Q | 100 | N/A | | | N/A |
| H1.157_L1 | VH-W112S | 100 | N/A | | | N/A |
| H1.158_L1 | VH-W112E | 100 | N/A | | | N/A |
| H1.159_L1 | VH-W112R | 100 | N/A | | | N/A |
| H1.160_L1 | VH-S113T | 100a | 9.068E-08 | 8.43E+04 | 7.64E-03 | 0.45 |
| H1.161_L1 | VH-S113A | 100a | 4.753E-08 | 1.59E+05 | 7.55E-03 | 0.86 |
| H1.162_L1 | VH-S113Q | 100a | N/A | | | N/A |
| H1.163_L1 | VH-S113G | 100a | 9.196E-08 | 1.23E+05 | 1.13E-02 | 0.44 |
| H1.164_L1 | VH-S113V | 100a | 2.8E-07 | 5.94E+04 | 1.66E-02 | 0.15 |
| H1.165_L1 | VH-S113H | 100a | N/A | | | N/A |
| H1.166_L1 | VH-S113D | 100a | 1.888E-07 | 2.42E+05 | 4.57E-02 | 0.22 |
| H1.167_L1 | VH-S113K | 100a | N/A | | | N/A |
| H1.168_L1 | VH-S113Y | 100a | N/A | | | N/A |
| H1_L1.1 | VL-N31H | 27d | 5.464E-09 | 9.73E+04 | 5.32E-04 | 7.45 |
| H1_L1.2 | VL-N31E | 27d | 1.519E-07 | 1.50E+05 | 2.28E-02 | 0.27 |
| H1_L1.3 | VL-N31S | 27d | 1.083E-08 | 1.53E+05 | 1.65E-03 | 3.76 |
| H1_L1.4 | VL-N31R | 27d | N/A | | | N/A |
| H1_L1.5 | VL-N31L | 27d | 3.294E-08 | 1.73E+05 | 5.69E-03 | 1.24 |
| H1_L1.6 | VL-N31T | 27d | 6.46E-08 | 1.20E+05 | 7.77E-03 | 0.63 |
| H1_L1.7 | VL-N31G | 27d | 8.462E-08 | 1.03E+05 | 8.75E-03 | 0.48 |
| H1_L1.8 | VL-N31Y | 27d | 3.069E-07 | 8.06E+04 | 2.47E-02 | 0.13 |
| H1_L1.9 | VL-S32T | 27e | 4.666E-08 | 1.07E+05 | 5.00E-03 | 0.87 |
| H1_L1.10 | VL-S32A | 27e | 8.287E-08 | 9.10E+04 | 7.55E-03 | 0.49 |
| H1_L1.11 | VL-S32Q | 27e | 1.033E-07 | 9.65E+04 | 9.97E-03 | 0.39 |
| H1_L1.12 | VL-S32V | 27e | 1.108E-07 | 1.04E+05 | 1.15E-02 | 0.37 |
| H1_L1.13 | VL-S32H | 27e | 1.033E-07 | 1.02E+05 | 1.06E-02 | 0.39 |
| H1_L1.14 | VL-S32K | 27e | 1.696E-07 | 8.32E+04 | 1.41E-02 | 0.24 |
| H1_L1.15 | VL-S32Y | 27e | 1.073E-07 | 9.08E+04 | 9.75E-03 | 0.38 |

Figure 65F

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1_L1.16 | VL-G33A | 27f | 1.289E-07 | 1.02E+05 | 1.32E-02 | 0.32 |
| H1_L1.17 | VL-G33Q | 27f | 1.81E-07 | 1.29E+05 | 2.34E-02 | 0.22 |
| H1_L1.18 | VL-G33H | 27f | 2.05E-07 | 1.23E+05 | 2.52E-02 | 0.20 |
| H1_L1.19 | VL-G33D | 27f | 2.059E-07 | 1.43E+05 | 2.95E-02 | 0.20 |
| H1_L1.20 | VL-G33K | 27f | 7.311E-08 | 1.84E+05 | 1.34E-02 | 0.56 |
| H1_L1.21 | VL-G33L | 27f | 3.566E-07 | 1.39E+05 | 4.95E-02 | 0.11 |
| H1_L1.22 | VL-G33Y | 27f | 2.714E-07 | 9.91E+04 | 2.69E-02 | 0.15 |
| H1_L1.23 | VL-N34D | 28 | 5.763E-08 | 1.04E+05 | 6.00E-03 | 0.71 |
| H1_L1.24 | VL-N34H | 28 | 1.998E-07 | 9.16E+04 | 1.83E-02 | 0.20 |
| H1_L1.25 | VL-N34E | 28 | 1.521E-07 | 8.09E+04 | 1.23E-02 | 0.27 |
| H1_L1.26 | VL-N34S | 28 | 1.771E-07 | 1.30E+05 | 2.29E-02 | 0.23 |
| H1_L1.27 | VL-N34R | 28 | 5.155E-08 | 2.27E+05 | 1.17E-02 | 0.79 |
| H1_L1.28 | VL-N34L | 28 | 4.032E-07 | 1.34E+05 | 5.39E-02 | 0.10 |
| H1_L1.29 | VL-N34T | 28 | 3.051E-07 | 1.33E+05 | 4.05E-02 | 0.13 |
| H1_L1.30 | VL-N34G | 28 | 6.186E-08 | 1.46E+05 | 9.01E-03 | 0.66 |
| H1_L1.31 | VL-N34Y | 28 | N/A | | | N/A |
| H1_L1.32 | VL-Q35E | 29 | 3.503E-08 | 1.36E+05 | 4.76E-03 | 1.16 |
| H1_L1.33 | VL-Q35H | 29 | 4.268E-08 | 1.33E+05 | 5.66E-03 | 0.95 |
| H1_L1.34 | VL-Q35N | 29 | 4.209E-08 | 1.07E+05 | 4.51E-03 | 0.97 |
| H1_L1.35 | VL-Q35K | 29 | 5.757E-08 | 1.11E+05 | 6.38E-03 | 0.71 |
| H1_L1.36 | VL-Q35A | 29 | 6.091E-08 | 1.11E+05 | 6.78E-03 | 0.67 |
| H1_L1.37 | VL-Q35F | 29 | 2.898E-08 | 1.26E+05 | 3.64E-03 | 1.40 |
| H1_L1.38 | VL-Q35I | 29 | 3.049E-08 | 1.44E+05 | 4.39E-03 | 1.33 |
| H1_L1.39 | VL-K36R | 30 | 5.45E-08 | 1.09E+05 | 5.96E-03 | 0.75 |
| H1_L1.40 | VL-K36E | 30 | 3.806E-08 | 1.20E+05 | 4.55E-03 | 1.07 |
| H1_L1.41 | VL-K36H | 30 | 3.967E-08 | 1.28E+05 | 5.08E-03 | 1.03 |
| H1_L1.42 | VL-K36D | 30 | 3.653E-08 | 1.34E+05 | 4.90E-03 | 1.11 |
| H1_L1.43 | VL-K36A | 30 | 3.98E-08 | 1.37E+05 | 5.46E-03 | 1.02 |
| H1_L1.44 | VL-K36G | 30 | 1.995E-08 | 1.46E+05 | 2.91E-03 | 2.04 |
| H1_L1.45 | VL-K36Y | 30 | 8.602E-09 | 1.57E+05 | 1.35E-03 | 4.73 |
| H1_L1.46 | VL-K36I | 30 | 2.637E-08 | 1.23E+05 | 3.24E-03 | 1.54 |
| H1_L1.47 | VL-N37D | 31 | 2.375E-08 | 1.49E+05 | 3.53E-03 | 1.71 |
| H1_L1.48 | VL-N37H | 31 | 8.012E-08 | 9.80E+04 | 7.85E-03 | 0.51 |
| H1_L1.49 | VL-N37E | 31 | 6.115E-08 | 1.14E+05 | 6.97E-03 | 0.67 |
| H1_L1.50 | VL-N37S | 31 | 4.214E-08 | 9.71E+04 | 4.09E-03 | 0.97 |
| H1_L1.51 | VL-N37R | 31 | 4.259E-08 | 1.11E+05 | 4.73E-03 | 0.96 |
| H1_L1.52 | VL-N37L | 31 | 5.023E-08 | 1.11E+05 | 5.59E-03 | 0.81 |

Figure 65G

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1_L1.53 | VL-N37T | 31 | 5.181E-08 | 9.31E+04 | 4.83E-03 | 0.79 |
| H1_L1.54 | VL-N37G | 31 | 6.67E-08 | 1.13E+05 | 7.53E-03 | 0.61 |
| H1_L1.55 | VL-N37Y | 31 | 8.036E-08 | 1.17E+05 | 9.42E-03 | 0.51 |
| H1_L1.56 | VL-Y38F | 32 | 1.96E-07 | 1.31E+05 | 2.56E-02 | 0.21 |
| H1_L1.57 | VL-Y38H | 32 | 1.569E-07 | 1.77E+05 | 2.78E-02 | 0.26 |
| H1_L1.58 | VL-Y38L | 32 | N/A | | | N/A |
| H1_L1.59 | VL-Y38W | 32 | N/A | | | N/A |
| H1_L1.60 | VL-Y38V | 32 | N/A | | | N/A |
| H1_L1.61 | VL-Y38A | 32 | N/A | | | N/A |
| H1_L1.62 | VL-Y38Q | 32 | N/A | | | N/A |
| H1_L1.63 | VL-Y38D | 32 | N/A | | | N/A |
| H1_L1.64 | VL-Y38K | 32 | N/A | | | N/A |
| H1_L1.65 | VL-T40A | 34 | 9.803E-08 | 9.68E+04 | 9.49E-03 | 0.42 |
| H1_L1.66 | VL-W56F | 50 | 3.527E-08 | 9.62E+04 | 3.39E-03 | 1.15 |
| H1_L1.67 | VL-W56L | 50 | 4.165E-08 | 1.00E+05 | 4.18E-03 | 0.98 |
| H1_L1.68 | VL-W56Y | 50 | 1.784E-07 | 9.29E+04 | 1.66E-02 | 0.23 |
| H1_L1.69 | VL-W56I | 50 | 2.586E-08 | 9.44E+04 | 2.44E-03 | 1.57 |
| H1_L1.70 | VL-W56H | 50 | 3.091E-08 | 9.07E+04 | 2.81E-03 | 1.32 |
| H1_L1.71 | VL-W56Q | 50 | 4.711E-08 | 9.14E+04 | 4.30E-03 | 0.86 |
| H1_L1.72 | VL-W56S | 50 | 6.026E-08 | 5.77E+04 | 3.48E-03 | 0.68 |
| H1_L1.73 | VL-W56D | 50 | 5.161E-08 | 8.81E+04 | 4.55E-03 | 0.79 |
| H1_L1.74 | VL-W56R | 50 | 2.646E-07 | 9.23E+04 | 2.44E-02 | 0.15 |
| H1_L1.75 | VL-T59V | 53 | 4.529E-08 | 1.10E+05 | 4.96E-03 | 0.90 |
| H1_L1.76 | VL-T59S | 53 | 5.499E-08 | 9.31E+04 | 5.12E-03 | 0.74 |
| H1_L1.77 | VL-T59A | 53 | 5.027E-08 | 1.06E+05 | 5.35E-03 | 0.81 |
| H1_L1.78 | VL-T59I | 53 | 5.679E-08 | 1.02E+05 | 5.81E-03 | 0.72 |
| H1_L1.79 | VL-T59Q | 53 | 5.548E-08 | 1.32E+05 | 7.31E-03 | 0.73 |
| H1_L1.80 | VL-T59H | 53 | 5.104E-08 | 1.13E+05 | 5.78E-03 | 0.80 |
| H1_L1.81 | VL-T59D | 53 | 5.135E-08 | 1.18E+05 | 6.06E-03 | 0.79 |
| H1_L1.82 | VL-T59K | 53 | 5.261E-08 | 1.14E+05 | 6.02E-03 | 0.77 |
| H1_L1.83 | VL-T59Y | 53 | 6.427E-08 | 9.38E+04 | 6.03E-03 | 0.63 |
| H1_L1.84 | VL-E61Q | 55 | 4.601E-08 | 1.04E+05 | 4.78E-03 | 0.88 |
| H1_L1.85 | VL-E61K | 55 | 3.18E-08 | 9.94E+04 | 3.16E-03 | 1.28 |
| H1_L1.86 | VL-E61S | 55 | 4.06E-08 | 1.16E+05 | 4.70E-03 | 1.00 |
| H1_L1.87 | VL-E61H | 55 | 5.085E-08 | 1.09E+05 | 5.52E-03 | 0.80 |
| H1_L1.88 | VL-E61A | 55 | 4.328E-08 | 9.50E+04 | 4.11E-03 | 0.94 |
| H1_L1.89 | VL-E61G | 55 | 4.388E-08 | 9.19E+04 | 4.03E-03 | 0.93 |

Figure 65H

| mAb C[PD-1] Variant Description | Substitution (Xencor #) | Kabat Position | $K_D$ (M) | $k_{on}$ (1/Ms) | $k_d$ (1/s) | Fold improvement over WT |
|---|---|---|---|---|---|---|
| H1_L1.90 | VL-E61F | 55 | 7.882E-08 | 9.67E+04 | 7.62E-03 | 0.52 |
| H1_L1.91 | VL-E61I | 55 | 6.125E-08 | 8.43E+04 | 5.16E-03 | 0.66 |
| H1_L1.92 | VL-S62T | 56 | 5.379E-08 | 1.05E+05 | 5.62E-03 | 0.76 |
| H1_L1.93 | VL-S62A | 56 | 5.386E-08 | 1.03E+05 | 5.53E-03 | 0.76 |
| H1_L1.94 | VL-S62Q | 56 | 7.002E-08 | 1.08E+05 | 7.54E-03 | 0.58 |
| H1_L1.95 | VL-S62V | 56 | 6.58E-08 | 1.28E+05 | 8.41E-03 | 0.62 |
| H1_L1.96 | VL-S62H | 56 | 3.358E-08 | 1.50E+05 | 5.04E-03 | 1.21 |
| H1_L1.97 | VL-S62K | 56 | 3.262E-08 | 1.32E+05 | 4.30E-03 | 1.25 |
| H1_L1.98 | VL-S62Y | 56 | 3.387E-08 | 1.59E+05 | 5.40E-03 | 1.20 |
| H1_L1.99 | VL-T69S | 63 | 3.21E-08 | 1.51E+05 | 4.83E-03 | 1.27 |
| H1_L1.100 | VL-D97Q | 91 | N/A | | | N/A |
| H1_L1.101 | VL-D97E | 91 | 6.962E-08 | 1.28E+05 | 8.92E-03 | 0.58 |
| H1_L1.102 | VL-D97H | 91 | N/A | | | N/A |
| H1_L1.103 | VL-D97S | 91 | N/A | | | N/A |
| H1_L1.104 | VL-D97R | 91 | N/A | | | N/A |
| H1_L1.105 | VL-D97L | 91 | N/A | | | N/A |
| H1_L1.106 | VL-D97T | 91 | 3.236E-07 | 2.77E+05 | 8.96E-02 | 0.13 |
| H1_L1.107 | VL-D97G | 91 | N/A | | | N/A |
| H1_L1.108 | VL-D97Y | 91 | N/A | | | N/A |
| H1_L1.109 | VL-Y98F | 92 | 6.694E-08 | 1.46E+05 | 9.78E-03 | 0.61 |
| H1_L1.110 | VL-Y98H | 92 | 1.123E-07 | 1.52E+05 | 1.70E-02 | 0.36 |
| H1_L1.111 | VL-Y98L | 92 | 8.078E-08 | 1.44E+05 | 1.16E-02 | 0.50 |
| H1_L1.112 | VL-Y98W | 92 | 7.415E-08 | 1.71E+05 | 1.27E-02 | 0.55 |
| H1_L1.113 | VL-Y98V | 92 | N/A | | | N/A |
| H1_L1.114 | VL-Y98A | 92 | N/A | | | N/A |
| H1_L1.115 | VL-Y98Q | 92 | N/A | | | N/A |
| H1_L1.116 | VL-Y98K | 92 | 1.533E-07 | 1.78E+05 | 2.73E-02 | 0.27 |
| H1_L1.117 | VL-S99T | 93 | 1.563E-08 | 1.61E+05 | 2.51E-03 | 2.60 |
| H1_L1.118 | VL-S99A | 93 | 7.512E-08 | 1.40E+05 | 1.05E-02 | 0.54 |
| H1_L1.119 | VL-S99Q | 93 | 2.119E-08 | 1.49E+05 | 3.15E-03 | 1.92 |
| H1_L1.120 | VL-S99G | 93 | 6.686E-08 | 1.82E+05 | 1.22E-02 | 0.61 |
| H1_L1.121 | VL-S99V | 93 | 1.681E-08 | 1.43E+05 | 2.41E-03 | 2.42 |
| H1_L1.122 | VL-S99H | 93 | 1.501E-08 | 1.34E+05 | 2.02E-03 | 2.71 |
| H1_L1.123 | VL-S99D | 93 | N/A | | | N/A |
| H1_L1.124 | VL-S99K | 93 | 1.059E-07 | 1.43E+05 | 1.52E-02 | 0.38 |
| H1_L1.125 | VL-S99F | 93 | 7.62E-08 | 1.65E+05 | 1.26E-02 | 0.53 |
| H1_L1.126 | VL-Y100F | 94 | 2.63E-08 | 1.61E+05 | 4.24E-03 | 1.55 |

Figure 65I

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1_L1.127 | VL-Y100H | 94 | 5.552E-08 | 1.33E+05 | 7.41E-03 | 0.73 |
| H1_L1.128 | VL-Y100L | 94 | 1.86E-07 | 4.90E+05 | 9.11E-02 | 0.22 |
| H1_L1.129 | VL-Y100W | 94 | 9.435E-09 | 1.06E+05 | 1.00E-03 | 4.31 |
| H1_L1.130 | VL-Y100V | 94 | N/A | | | N/A |
| H1_L1.131 | VL-Y100A | 94 | N/A | | | N/A |
| H1_L1.132 | VL-Y100Q | 94 | 3.70E-08 | 1.66E+05 | 6.15E-03 | 1.10 |
| H1_L1.133 | VL-Y100D | 94 | 4.049E-07 | 6.51E+04 | 2.64E-02 | 0.10 |
| H1_L1.134 | VL-Y100K | 94 | 9.13E-08 | 1.68E+05 | 1.53E-02 | 0.45 |

Figure 66

| Description (in the context of PD-1-targeted IL15/Rα-Fc) | Substitution (Xencor #) | Kabat Position | $K_D$ (M) | $k_a$ (1/Ms) | $k_d$ (1/s) |
|---|---|---|---|---|---|
| H1L1 (XENP28543) | WT | | 6.71E-08 | 1.04E+05 | 6.95E-03 |
| H1_L1.1 (XENP30046) | VL-N31H | VL-27d | 5.40E-09 | 9.04E+04 | 4.88E-04 |
| H1.19_L1.1 (XENP30269) | VH-F34L VL-N31H | VH-32 VL-27d | 2.29E-09 | 7.44E+04 | 1.70E-04 |
| H1.132_L1.1 (XENP30272) | VH-R109W VL-N31H | VH-97 VL-27d | 3.13E-09 | 1.33E+05 | 4.18E-04 |

Figure 67

| Description of mAb C Variant (in the context of PD-1-targeted IL15/Rα-Fc) | Substitution (Xencor #) | Kabat Position | $K_D$ (M) | $k_a$ (1/Ms) | $k_d$ (1/s) |
|---|---|---|---|---|---|
| H1L1 (XENP29483) | WT | | 5.88E-08 | 8.92E+04 | 0.00525 |
| H1_L1.1 (XENP30049) | VL-N31H | VL-27d | 5.30E-09 | 6.16E+04 | 3.27E-04 |
| H1.19_L1.1 (XENP30275) | VH-F34L VL-N31H | VH-32 VL-27d | 4.35E-09 | 6.26E+04 | 2.72E-04 |
| H1.169_L1.1 (XENP30273) | VH-F34L/S55G VL-N31H | VH-32/52A VL-27d | 3.10E-09 | 6.20E+04 | 1.93E-04 |
| H1.175_L1.1 (XENP30274) | VH-F34L/S55G/R109W VL-N31H | VH-32/52A/97 VL-27d | 1.24E-09 | 9.50E+04 | 1.18E-04 |
| H1_L1.140 (XENP30449) | VL-N31H/K36Y/S99T | VL-27d/30/93 | 1.62E-09 | 7.48E+04 | 1.22E-04 |
| H1_L1.135 (XENP30444) | VL-N31H/K36Y | VL-27d/30 | 2.84E-09 | 7.02E+04 | 2.00E-04 |
| H1_L1.136 (XENP30445) | N31H/S99T | VL-27d/93 | 2.02E-09 | 5.98E+04 | 1.21E-04 |
| H1.132_L1.135 (XENP30486) | VH-R109W VL-N31H/K36Y | VH-97 VL-27d/30 | 8.28E-10 | 1.36E+05 | 1.12E-04 |
| H1.132_L1.140 (XENP30487) | VH-R109W VL-N31H/K36Y/S99T | VH-97 VL-N27dH/K30Y/S93T | 5.43E-10 | 1.45E+05 | 7.88E-05 |
| H1.175_L1.135 (XENP30488) | VH-F34L/S55G/R109W VL-N31H/K36Y | VH-32/52A/97 VL-27d/30 | 6.97E-10 | 1.20E+05 | 8.33E-05 |
| H1.175_L1.140 (XENP30489) | VH-F34L/S55G/R109W VL-N31H/K36Y/S99T | VH-32/52A/97 VL-27d/30/93 | 6.24E-10 | 1.26E+05 | 7.88E-05 |

Figure 68A

>XENP30046 human_IL15Ra(sushi)_(GGGGS)5-human_IL15(N4D/N65D;single-chain)-mAb C[PD-1]_H1_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 567)
*ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK*

Chain 2 - mAb C[PD-1]_H1_IgG1_PVA_/S267K/S364K/E357Q (SEQ ID NO: 568)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.1 (SEQ ID NO: 569)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30047 human_IL15Ra(sushi)_(GGGGS)5-human_IL15(N4D/N65D;single-chain)-mAb C[PD-1]_H1_L1.3_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 570)
*ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK*

Chain 2 - mAb C[PD-1]_H1_IgG1_PVA_/S267K/S364K/E357Q (SEQ ID NO: 571)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.3 (SEQ ID NO: 572)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68B

>XENP30049 human_IL15Ra(sushi)_(GGGGS)5-human_IL15(D30N/N65D;single-chain)-mAb C[PD-1]_H1_L1.1_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 573)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1_IgG1_PVA_/S267K/S364K/E357Q (SEQ ID NO: 574)
EVQLVESGGGLVQPGGSLRLSCAASGFTFSS<u>FGMH</u>WVRQAPGKGLEWVS<u>YISSGSSIIYYADSVK</u>GRFTISRDNAKNSLYLQMNSL
RAEDTAVYYCAR<u>GGRLVWSPDY</u>WGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.1 (SEQ ID NO: 575)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

>XENP30050 human_IL15Ra(sushi)_(GGGGS)5-human_IL15(D30N/N65D;single-chain)-mAb C[PD-1]_H1_L1.3_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 576)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1_IgG1_PVA_/S267K/S364K/E357Q (SEQ ID NO: 577)
EVQLVESGGGLVQPGGSLRLSCAASGFTFSS<u>FGMH</u>WVRQAPGKGLEWVS<u>YISSGSSIIYYADSVK</u>GRFTISRDNAKNSLYLQMNSL
RAEDTAVYYCAR<u>GGRLVWSPDY</u>WGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.3 (SEQ ID NO: 578)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68C

>XENP30269 human_IL15Ra(sushi)_(GGGGS)5-human_IL15(N4D/N65D;single-chain)-mAb C[PD-1]_H1.19_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 579)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.19_IgG1_PVA_/S267K/S364K/E357Q (SEQ ID NO: 580)
EVQLVESGGGLVQPGGSLRLSCAASGFTFSSLGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.1 (SEQ ID NO: 581)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30272 human_IL15Ra(sushi)_(GGGGS)5-human_IL15(N4D/N65D;single-chain)-mAb C[PD-1]_H1.132_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 582)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.132_IgG1_PVA_/S267K/S364K/E357Q (SEQ ID NO: 583)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGWLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.1 (SEQ ID NO: 584)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68D

>XENP30273 human_IL15Ra(sushi)_(GGGGS)5-human_IL15(N4D/N65D;single-chain)-mAb C[PD-
1]_H1.169_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S (SEQ ID NO: 585)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.169_IgG1_PVA_/S267K/S364K/E357Q (SEQ ID NO: 586)
EVQLVESGGGLVQPGGSLRLSCAASGFTFSSLGMHWVRQAPGKGLEWVSYISGGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.1 (SEQ ID NO: 587)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30274 human_IL15Ra(sushi)_(GGGGS)5-human_IL15(N4D/N65D;single-chain)-mAb C[PD-
1]_H1.175_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S (SEQ ID NO: 588)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.175_IgG1_PVA_/S267K/S364K/E357Q (SEQ ID NO: 589)
EVQLVESGGGLVQPGGSLRLSCAASGFTFSSLGMHWVRQAPGKGLEWVSYISGGSSIIYYADSVKGRFTISRDNAKNSLYLQMNSL
RAEDTAVYYCARGGWLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.1 (SEQ ID NO: 590)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68E

>XENP30275 human_IL15Ra(sushi)_(GGGGS)5-human_IL15(D30N/N65D;single-chain)-mAb C[PD-1]_H1.19_L1.1_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 591)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.19_IgG1_PVA_/S267K/S364K/E357Q (SEQ ID NO: 592)
EVQLVESGGGLVQPGGSLRLSCAASGFTFSSLGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.1 (SEQ ID NO: 593)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30444 human_IL15Ra(sushi)_(GGGGS)5-human_IL15(D30N/N65D;single-chain)-mAb C[PD-1]_H1_L1.135_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 594)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1_IgG1_PVA_/S267K/S364K/E357Q (SEQ ID NO: 595)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.135 (SEQ ID NO: 596)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68F

>XENP30445 human_IL15Ra(sushi)_(GGGGS)5-human_IL15(D30N/N65D;single-chain)-mAb C[PD-
1]_H1_L1.136_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 597)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1_IgG1_PVA_/S267K/S364K/E357Q (SEQ ID NO: 598)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.136 (SEQ ID NO: 599)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYTYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30449 human_IL15Ra(sushi)_(GGGGS)5-human_IL15(D30N/N65D;single-chain)-mAb C[PD-
1]_H1_L1.140_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 600)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1_IgG1_PVA_/S267K/S364K/E357Q (SEQ ID NO: 601)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.140 (SEQ ID NO: 602)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYTYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68G

>XENP30486 human_IL15Ra(sushi)_(GGGGS)5-human_IL15(N4D/N65D;single-chain)-mAb C[PD-1]_H1.132_L1.135_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S (SEQ ID NO: 603)
*ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK*

Chain 2 - mAb C[PD-1]_H1.132_IgG1_PVA_/S267K/S364K/E357Q (SEQ ID NO: 604)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGWLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.135 (SEQ ID NO: 605)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

>XENP30487 human_IL15Ra(sushi)_(GGGGS)5-human_IL15(N4D/N65D;single-chain)-mAb C[PD-1]_H1.132_L1.140_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(N4D/N65D;single-chain)_IgG1_Fc(216)_IgG1_pI(-)_Isosteric_A_C220S/PVA_/S267K/L368D/K370S (SEQ ID NO: 606)
*ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK*

Chain 2 - mAb C[PD-1]_H1.132_IgG1_PVA_/S267K/S364K/E357Q (SEQ ID NO: 607)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGWLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C[PD-1]_L1.140 (SEQ ID NO: 608)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYTYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 68H

>XENP30488 human_IL15Ra(sushi)_(GGGGS)5-human_IL15(N4D/N65D;single-chain)-mAb C[PD-
1]_H1.175_L1.135_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S (SEQ ID NO: 609)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.175_IgG1_PVA_/S267K/S364K/E357Q (SEQ ID NO: 610)
EVQLVESGGGLVQPGGSLRLSCAASGFTFSSLGMHWVRQAPGKGLEWVSYISGGSSIIYYADSVKGRFTISRDNAKNSLYLQMNSL
RAEDTAVYYCARGGWLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.135 (SEQ ID NO: 611)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30489 human_IL15Ra(sushi)_(GGGGS)5-human_IL15(N4D/N65D;single-chain)-mAb C[PD-
1]_H1.175_L1.140_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S (SEQ ID NO: 612)
*ITCPPPMSVEHADIWVKSYSLYSRERYICNSGFKRKAGTSSLTECVLNKATNVAHWTTPSLKCIR*/GGGGSGGGGSGGGGSGGGGS
GGGGS/*NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS*/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - mAb C[PD-1]_H1.175_IgG1_PVA_/S267K/S364K/E357Q (SEQ ID NO: 613)
EVQLVESGGGLVQPGGSLRLSCAASGFTFSSLGMHWVRQAPGKGLEWVSYISGGSSIIYYADSVKGRFTISRDNAKNSLYLQMNSL
RAEDTAVYYCARGGWLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK Chain 3 - mAb C_L1.140 (SEQ ID NO: 614)
DIVMTQSPDSLAVSLGERATINCKSSQSLLHSGNQYNYLTWYQQKPGQPPKLLIYWASTRESGVPDRFTGSGSGTDFTLTISSLQA
EDVAVYYCQNDYTYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 69A

>XENP30290 human_IL15Ra(sushi)_(GGGGS)5-human_IL15(N4D/N65D;single-chain)-mAb C[PD-1]_H1_L1.1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S/M428L/N434S (SEQ ID NO: 615)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 616)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1.1 (SEQ ID NO: 617)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30291 human_IL15Ra(sushi)_(GGGGS)5-human_IL15(N4D/N65D;single-chain)-mAb C[PD-1]_H1_L1.3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S/M428L/N434S (SEQ ID NO: 618)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVDVISDLKKIEDLIQSMHIDATLYTESDVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 619)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1.3 (SEQ ID NO: 620)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 69B

>XENP30292 human_IL15Ra(sushi)_(GGGGS)5-human_IL15(D30N/N65D;single-chain)-mAb C[PD-1]_H1_L1.1_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S/M428L/N434S (SEQ ID NO: 621)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 622)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1.1 (SEQ ID NO: 623)
DIVMTQSPDSLAVSLGERATINCKSSQSLLHSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP30293 human_IL15Ra(sushi)_(GGGGS)5-human_IL15(D30N/N65D;single-chain)-mAb C[PD-1]_H1_L1.3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S/M428L/N434S (SEQ ID NO: 624)
ITCPPPMSVEHADIWVKSYSLYSRERYICNSGFKRKAGTSSLTECVLNKATNVAHWTTPSLKCIR/GGGGSGGGGSGGGGSGGGGS
GGGGS/NWVNVISDLKKIEDLIQSMHIDATLYTESNVHPSCKVTAMKCFLLELQVISLESGDASIHDTVEDLIILANNSLSSNGNV
TESGCKECEELEEKNIKEFLQSFVHIVQMFINTS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVLHEALHSHYTQK
SLSLSPGK Chain 2 - mAb C[PD-1]_H1_IgG1_PVA_/S267K/S364K/E357Q/M428L/N434S (SEQ ID NO: 625)
EVQLVESGGGLVQPGGSLRLSCAASGFTFSSFGMHWVRQAPGKGLEWVSYISSGSSIIYYADSVKGRFTISRDNAKNSLYLQMNSL
RAEDTAVYYCARGGRLVWSPDYWGQGTLVTVSS/ASTKGPSVFPLAPSSKSTSGGTAALGCLVKDYFPEPVTVSWNSGALTSGVHT
FPAVLQSSGLYSLSSVVTVPSSSLGTQTYICNVNHKPSNTKVDKKVEPKSCDKTHTCPPCPAPPVAGPSVFLFPPKPKDTLMISRT
PEVTCVVVDVKHEDPEVKFNWYVDGVEVHNAKTKPREEQYNSTYRVVSVLTVLHQDWLNGKEYKCKVSNKALPAPIEKTISKAKGQ
PREPQVYTLPPSREQMTKNQVKLTCLVKGFYPSDIAVEWESNGQPENNYKTTPPVLDSDGSFFLYSKLTVDKSRWQQGNVFSCSVL
HEALHSHYTQKSLSLSPGK Chain 3 - mAb C[PD-1]_L1.3 (SEQ ID NO: 626)
DIVMTQSPDSLAVSLGERATINCKSSQSLLSSGNQKNYLTWYQQKPGQPPKLLIYWASTRESGVPDRFTGSGSGTDFTLTISSLQA
EDVAVYYCQNDYSYPFTFGSGTKLEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC Figure 77
A)
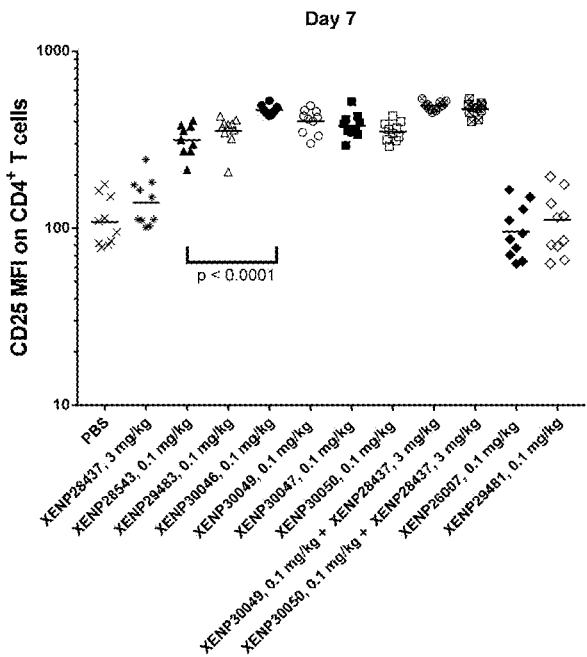
B)
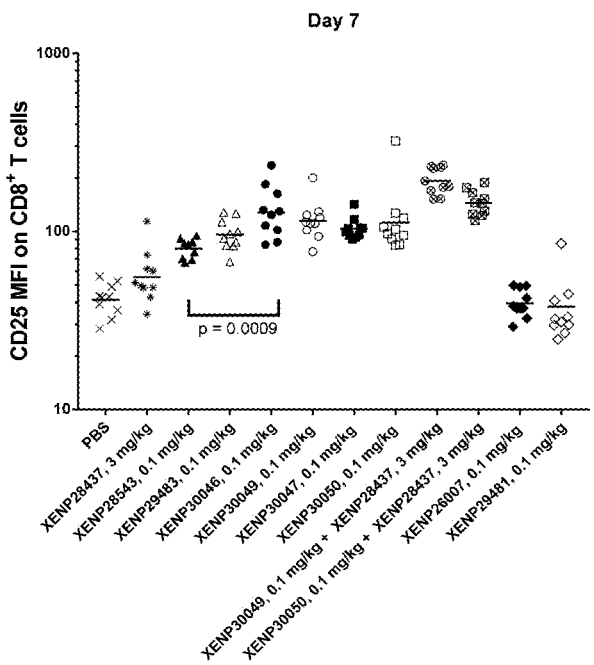

Figure 85
A)
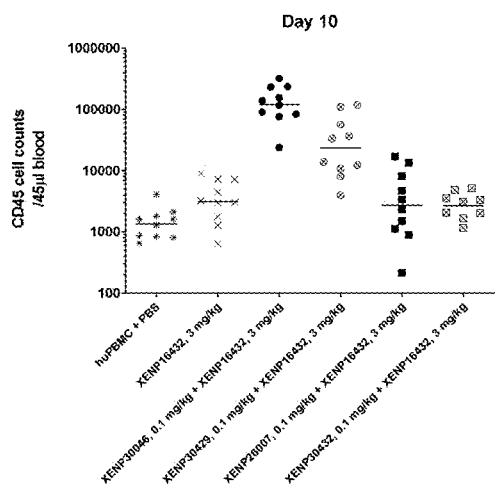
B)
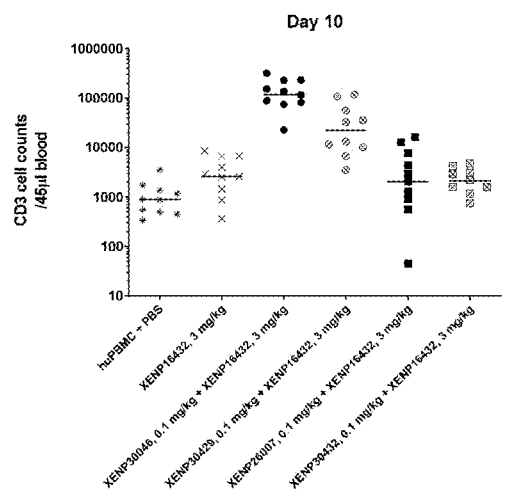
C)
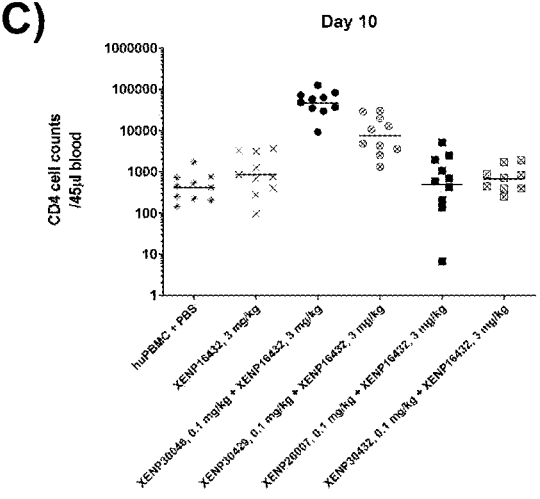
D)
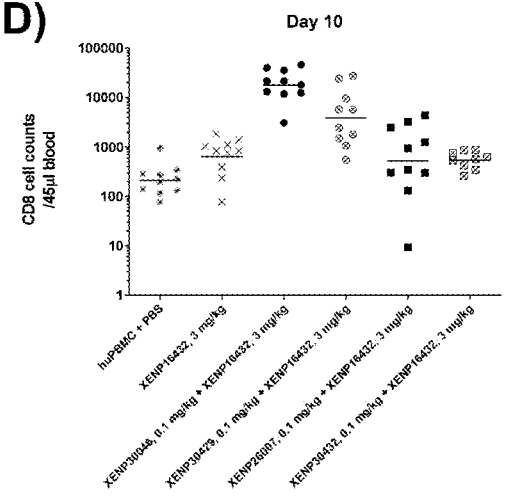

Figure 86
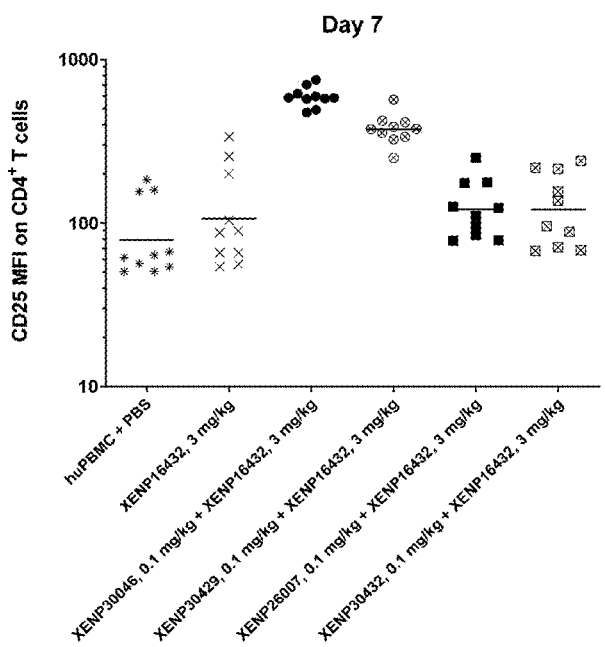
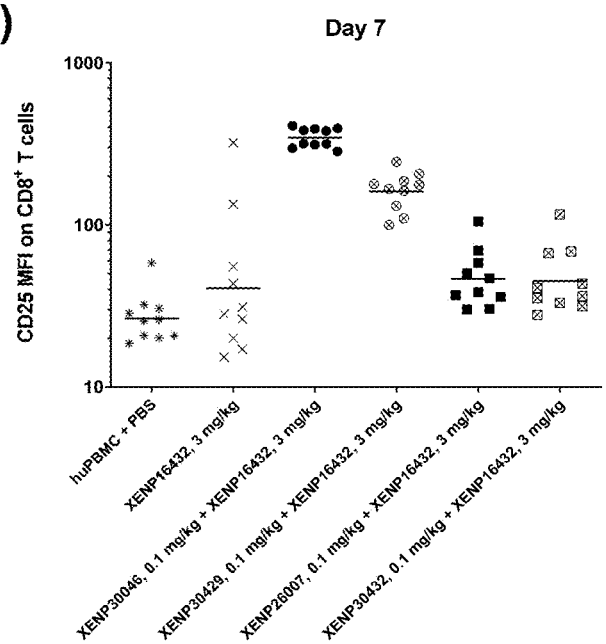

Figure 89
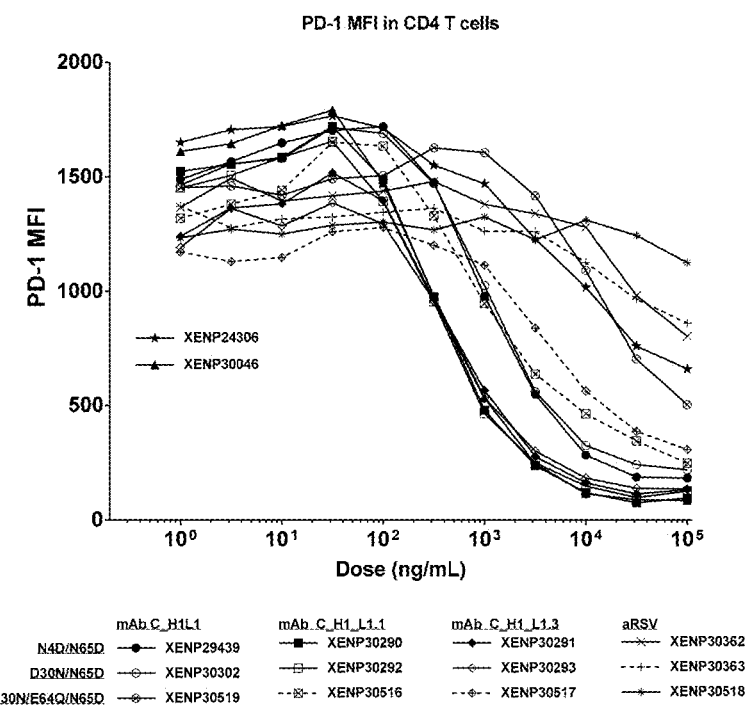
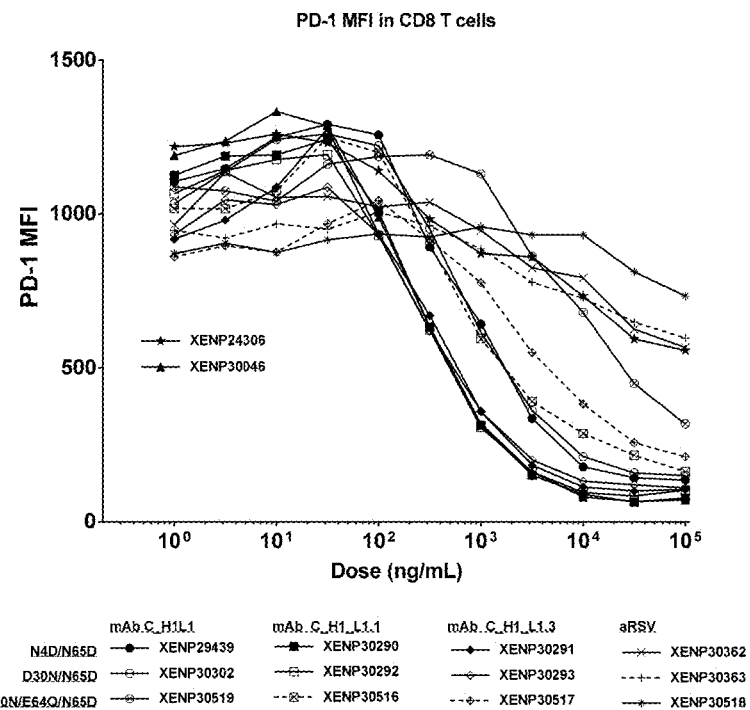

Figure 103
A)
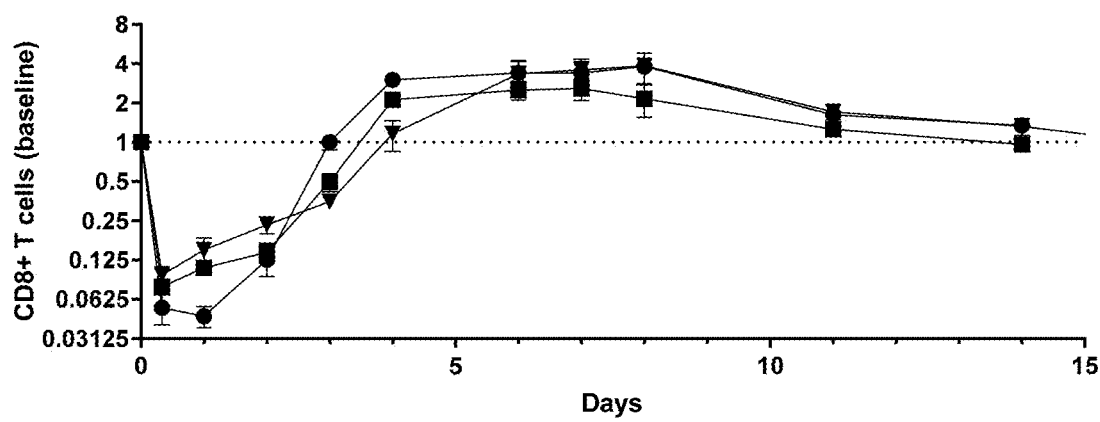
B)
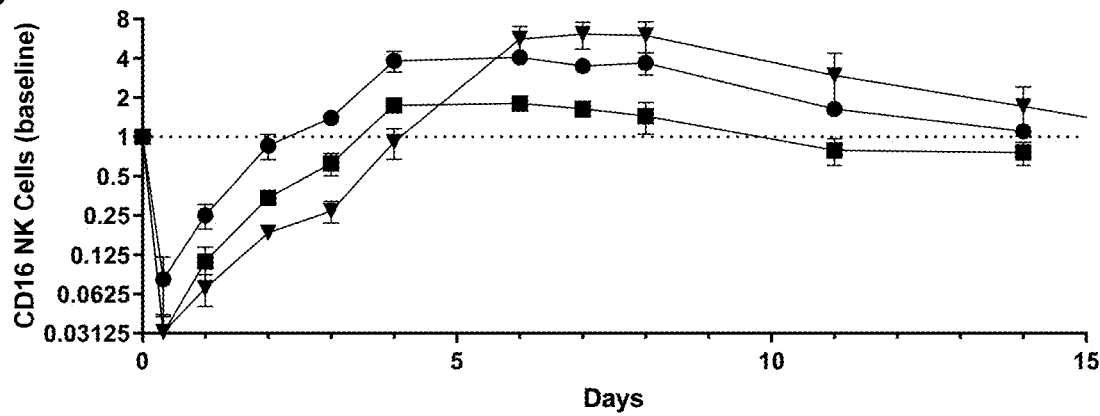
- ● XENP22853 (IL-15(WT)/Rα-Fc); 0.3X Dose)
- ■ XENP25937 (PD-1-targeted IL-15(N4D/N65D)/Rα-Fc; 1X Dose)
- ▼ XENP24306 (IL-15(D30N/E64Q/N65D)/Rα-Fc; 0.3X Dose)

Figure 104
A)
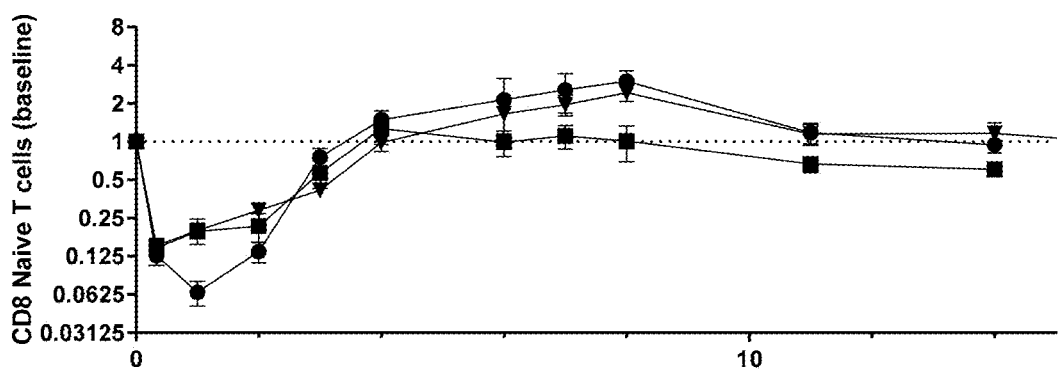
B)
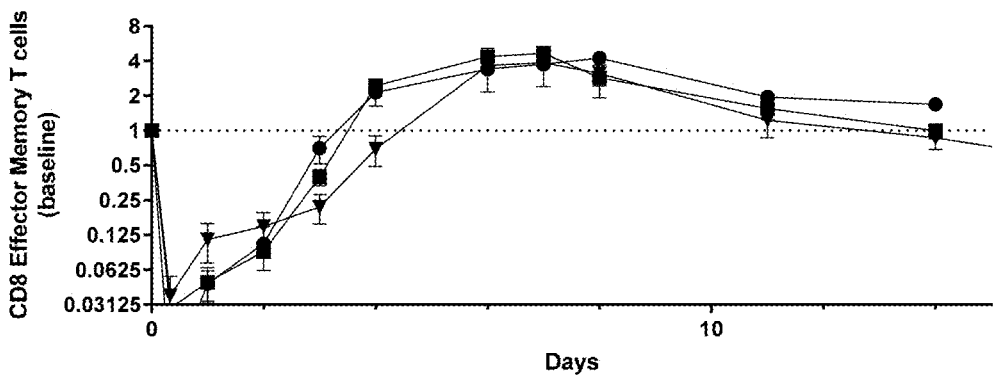

- PD1 x IL-15[N4D/N65D]; 3X dose
- PD1 x IL-15[N4D/N65D]; 10X dose
- PD1 x IL-15[D30N/E64Q/N65D]; 3X dose
- PD1 x IL-15[D30N/E64Q/N65D]; 10X dose
- PD1 x IL-15[D30N/E64Q/N65D]; 30X dose

- PD1 x IL-15[N4D/N65D]; 3X dose
- PD1 x IL-15[N4D/N65D]; 10X dose
- PD1 x IL-15[D30N/E64Q/N65D]; 3X dose
- PD1 x IL-15[D30N/E64Q/N65D]; 10X dose
- PD1 x IL-15[D30N/E64Q/N65D]; 30X dose

Figure 120

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-)_Isosteric_A_C220S/PVA_/S267K/L368D/K370S (SEQ ID NO: 627)
NWVNVISDLKKIEDLIQSMHIDATLYTESDVHPSCKVTAMKCFLLELQVISLESGDASIHDTVENLIILANNSLSSNGNVTESGCK
ECEELEEKNIKEFLQSFVHIVQMFINTS/GGGGS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - human_IL15Rα(Sushi)_(GGGGS)₁_Fc(216)_IgG1_C220S/PVA_/S267K/S364K/E357Q (SEQ ID NO: 628)
ITCPPPMSVEHADIWVKSYSLYSRERYICNSGFKRKAGTSSLTECVLNKATNVAHWTTPSLKCIR/GGGGS/EPKSSDKTHTCPPC
PAPPVAGPSVFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK >XENP022821 - human_IL15_N65D_(GGGGS)₁-human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) (SEQ ID NO: 629)
NWVNVISDLKKIEDLIQSMHIDATLYTESDVHPSCKVTAMKCFLLELQVISLESGDASIHDTVEDLIILANNSLSSNGNVTESGCK
ECEELEEKNIKEFLQSFVHIVQMFINTS/GGGGS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 - human_IL15Rα(Sushi)_(GGGGS)₁_Fc(216)_IgG1_pI(-)_Isosteric_A_C220S/PVA_/S267K/L368D/K370S-Fc(216)_IgG1_C220S/PVA_/S267K/S364K/E357Q (15908) (SEQ ID NO: 630)
ITCPPPMSVEHADIWVKSYSLYSRERYICNSGFKRKAGTSSLTECVLNKATNVAHWTTPSLKCIR/GGGGS/EPKSSDKTHTCPPC
PAPPVAGPSVFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK >XENP024045 human_IL15_D30N/E64Q/N65D_(GGGGS)1-human_IL15Rα(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q Chain 1 – human_IL15_D30N/E64Q/N65D_(GGGGS)1_Fc(216)_IgG1_pI(-)_Isosteric_A_C220S/PVA_/S267K/L368D/K370S (SEQ ID NO: 631)
NWVNVISDLKKIEDLIQSMHIDATLYTESNVHPSCKVTAMKCFLLELQVISLESGDASIHDTVQDLIILANNSLSSNGNVTESGCK
ECEELEEKNIKEFLQSFVHIVQMFINTS/GGGGS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYTLPP
SREEMTKNQVSLTCDVSGFYPSDIAVEWESDGQPENNYKTTPPVLDSDGSFFLYSKLTVDKSRWEQGDVFSCSVMHEALHNHYTQK
SLSLSPGK Chain 2 – human_IL15Rα(Sushi)_(GGGGS)1_Fc(216)_IgG1_C220S/PVA_/S267K/S364K/E357Q (SEQ ID NO: 632)
ITCPPPMSVEHADIWVKSYSLYSRERYICNSGFKRKAGTSSLTECVLNKATNVAHWTTPSLKCIR/GGGGS/EPKSSDKTHTCPPC
PAPPVAGPSVFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK

US 11,377,477 B2

PD-1 TARGETED IL-15/IL-15RALPHA FC FUSION PROTEINS AND USES IN COMBINATION THERAPIES THEREOF

PRIORITY CLAIM

This application claims priority to U.S. Provisional Patent Application No. 62/744,946, filed Oct. 12, 2018 and U.S. Provisional Patent Application No. 62/784,334, filed Dec. 21, 2018.

SEQUENCE LISTING

The instant application contains a Sequence Listing which has been submitted electronically in ASCII format and is hereby incorporated by reference in its entirety. Said ASCII copy, created on Dec. 20, 2019, is named 067461-5205-US_SL.txt and is 1,154,301 bytes in size.

BACKGROUND OF THE INVENTION

Two very promising approaches in cancer immunotherapy include cytokine-based treatments and blockade of immune checkpoint proteins such as PD-1.

Cytokines such as IL-2 and IL-15 function in aiding the proliferation and differentiation of B cells, T cells, and NK cells. Both cytokines exert their cell signaling function through binding to a trimeric complex consisting of two shared receptors, the common gamma chain (γc; CD132) and IL-2 receptor beta-chain (IL-2Rβ; CD122), as well as an alpha chain receptor unique to each cytokine: IL-2 receptor alpha (IL-2Rα; CD25) or IL-15 receptor alpha (IL-15Rα; CD215). Both cytokines are considered as potentially valuable therapeutics in oncology, and IL-2 has been approved for use in patients with metastatic renal-cell carcinoma and malignant melanoma. Currently, there are no approved uses of recombinant IL-15, although several clinical trials are ongoing. However, as potential drugs, both cytokines suffer from a very fast clearance, with half-lives measured in minutes. IL-2 immunotherapy has been associated with systemic toxicity when administered in high doses to overcome fast clearance. Such systemic toxicity has also been reported with IL-15 immunotherapy in recent clinical trials (Guo et al., J Immunol, 2015, 195(5):2353-64).

Immune checkpoint proteins such as PD-1 are up-regulated following T cell activation to preclude autoimmunity by exhausting activated T cells upon binding to immune checkpoint ligands such as PD-L1. However, immune checkpoint proteins are also up-regulated in tumor-infiltrating lymphocytes (TILs), and immune checkpoint ligands are overexpressed on tumor cells, contributing to immune escape by tumor cells. De-repression of TILs by blockade of immune checkpoint interactions by drugs such as Opdivo® (nivolumab) and Keytruda® (pembrolizumab) have proven highly effective in treatment of cancer. Despite the promise of checkpoint blockade therapies such as nivolumab and pembrolizumab, many patients still fail to achieve sufficient response to checkpoint blockade alone.

Therefore, there remains an unmet need in oncology treatment for therapeutic strategies with cytokines which do not require high doses and are targeted to tumors to avoid systemic toxicity. Further, there is a need to identify additional therapeutic modalities to stack with checkpoint blockade that could increase patient response rate. This can be especially complex as the additional therapeutic modality should not compete with the checkpoint blockade. The present invention addresses these needs and caveats by providing PD-1-targeted IL-15 fusion proteins with enhanced half-life and more selective targeting of TILs to improve safety profile, and which do not compete with checkpoint blockade antibodies with which they may be combined.

BRIEF SUMMARY OF THE INVENTION

The invention is directed to fusion proteins that include the combination of IL-15 complexes generally comprising an IL-15 domain, an IL-15Rα domain, and an anti-PD-1 antigen binding domain (ABD) that does not compete for binding with nivolumab or pembrolizumab.

Accordingly, in some aspects, the present invention provides targeted IL-15/Rα heterodimeric Fc fusion proteins comprising: a) a first monomer comprising, from N- to C-terminal: i) a IL-15 Rα sushi domain protein; ii) a first domain linker; iii) An IL-15 protein; and iv) a first variant Fc domain; and b) a second monomer comprising a heavy chain comprising VH-CH1-hinge-CH2-CH3, wherein said CH2-CH3 is a second variant Fc domain; c) a third monomer comprising a light chain comprising VL-CL; wherein said VH and VL domains form an antigen binding domain that binds to human PD-1 and does not compete for the human PD-1 with nivolumab and/or pembrolizumab.

In additional aspects, the targeted IL-15/Rα heterodimeric Fc fusion proteins has a VH domain which is a variant of SEQ ID NO:5 comprising the amino acid substitution F32L and the VL domain is a variant of SEQ ID NO:6 comprising N27dH, and optionally further comprising the amino acid substitutions K30Y/S93T.

In further aspects, the targeted IL-15/Rα heterodimeric Fc fusion protein has the H1 VH and the L1.1 VL.

In additional aspects, the targeted IL-15/Rα heterodimeric Fc fusion proteins have a variant IL-15 protein comprising amino acid substitution(s) selected from the group of D30N/E64Q/N65D; D30N/N65D; N1D; N4D; D8N; D30N; D61N; E64Q; N65D; Q108E; N1D/N4D/D8N; N1D/N4D/N65D; N1D/D30N; N1D/D61N; N1D/D61N/E64Q/Q108E; N1D/E64Q; N1D/N65D; N1D/Q108E; N4D; N4D/D30N; N4D/D61N; N4D/D61N/N65D; N4D/D61N/E64Q/Q108E; N4D/E64Q; N4D/N65D; D8N/D61N; D8N/E64Q; D30N/E64Q; D30N/Q180E; D61N/E64Q/N65D; E64Q; E64Q/N65D; E64Q/Q108E; and N65D/Q108E (as compared to SEQ ID NO:2).

In further aspects, the targeted IL-15/Rα heterodimeric Fc fusion proteins have a first variant Fc domain and a second variant Fc domains comprise amino acid substitutions L368D/K370S:LS364K/E357Q, according to EU numbering.

In additional aspects, the targeted IL-15/Rα heterodimeric Fc fusion proteins of the invention have a first variant Fc domain and a second variant Fc domain that each comprise amino acid substitutions M428L/N343S, according to EU numbering.

In further aspects, the targeted IL-15/Rα heterodimeric Fc fusion protein comprise: a) a first monomer comprising, from N- to C-terminal: i) a IL-15 Rα sushi domain protein; ii) a first domain linker; iii) a variant IL-15 protein; iv) a second domain linker; and v) a first variant Fc domain comprising CH2-CH3; and b) a second monomer comprising from N- to C-terminal: i) an scFv domain; ii) a third domain linker; iii) a second variant Fc domain comprising CH2-CH3; wherein said scFv domain comprises a first variable heavy domain, an scFv linker, and a first variable light domain, wherein said scFv domain binds human PD-1 and does not compete for said human PD-1 with nivolumab and/or pembrolizumab.

In additional aspects, the targeted IL-15/Rα heterodimeric Fc fusion proteins comprise: a) a first monomer comprising, from N- to C-terminal: i) an IL-15 Rα sushi domain protein; ii) a first domain linker; iii) a first variant Fc domain comprising CH2-CH3; b) a second monomer comprising, from N- to C-terminal: i) an scFv domain; ii) a third domain linker; iii) a second variant Fc domain comprising CH2-CH3; wherein said scFv domain comprises a first variable heavy domain, an scFv linker, and a first variable light domain, and said scFv domain binds human PD-1 and does not compete for said human PD-1 with nivolumab and/or pembrolizumab; and c) a third monomer comprising a variant IL-15 domain protein.

In further aspects, the targeted IL-15/Rα heterodimeric Fc fusion proteins comprise: a) a first monomer comprising a heavy chain comprising VH-CH1-hinge-CH2-CH3, wherein said CH2-CH3 is a first variant Fc domain; b) a second monomer comprising, from N- to C-terminal: i) an IL-15 Rα sushi domain protein; ii) a second domain linker; iii) a second variant Fc domain comprising CH2-CH3; b) a third monomer comprising a variant IL-15 domain protein; c) a fourth monomer comprising a light chain comprising VL-CL; wherein said VH and VL domains form an antigen binding domain that binds to human PD-1 and does not compete for said human PD-1 with nivolumab and/or pembrolizumab.

In additional aspects, the targeted IL-15/Rα heterodimeric Fc fusion proteins comprises: a) a first monomer comprising a heavy chain comprising VH-CH1-hinge-CH2-CH3, wherein said CH2-CH3 is a first variant Fc domain; b) a second monomer comprising VH-CH1-hinge-CH2-CH3-domain linker-IL-15Rα sushi domain protein-domain linker-variant IL-15 domain protein, wherein said CH2-CH3 is a second variant Fc domain; c) a third monomer comprising a light chain comprising VL-CL; wherein said VH and VL domains form an antigen binding domain that binds to human PD-1 and does not compete for said human PD-1 with nivolumab and/or pembrolizumab.

In further aspects, the targeted IL-15/Rα heterodimeric Fc fusion proteins comprise: a) a first monomer comprising a heavy chain comprising VH-CH1-hinge-CH2-CH3, wherein said CH2-CH3 is a first variant Fc domain; b) a second monomer comprising VH-CH1-hinge-CH2-CH3-domain linker-IL-15Rα sushi domain protein, wherein said CH2-CH3 is a second variant Fc domain; c) a third monomer comprising a variant IL-15 domain protein; d) a fourth monomer comprising a light chain comprising VL-CL; wherein said VH and VL domains bind to human PD-1 and does not compete for said human PD-1 with nivolumab and/or pembrolizumab.

In additional aspects, the targeted IL-15/Rα heterodimeric Fc fusion proteins comprise: a) a first monomer comprising, from N- to C-terminal: a VH-CH1-domain linker-variant IL-15 domain protein-domain linker-CH2-CH3, wherein said CH2-CH3 is a first variant Fc domain; b) a second monomer comprising, from N- to C-terminal: a VH-CH1-domain linker-IL-15 Rα sushi domain protein-domain linker-CH2-CH3, wherein said CH2-CH3 is a second variant Fc domain; c) a third monomer comprising a light chain comprising VL-CL; wherein said VH and VL domains form an antigen binding domain that binds to human PD-1 and does not compete for said human PD-1 with nivolumab and/or pembrolizumab.

In further aspects, the targeted IL-15/Rα heterodimeric Fc fusion protein comprising: a) a first monomer comprising, from N- to C-terminal: a VH-CH1-domain linker-variant IL-15 Rα sushi domain protein-domain linker-variant IL-15 domain protein-domain linker-CH2-CH3, wherein said CH2-CH3 is a first variant Fc domain; b) a second monomer comprising a heavy chain comprising VH-CH1-hinge CH2-CH3, wherein said CH2-CH3 is a second variant Fc domain; c) a third monomer comprising a light chain comprising VL-CL; wherein said VH and VL domains form an antigen binding domain that binds to human PD-1 and does not compete for said human PD-1 with nivolumab and/or pembrolizumab.

In additional aspects, the invention provides nucleic acid compositions comprising: a) a first nucleic acid encoding the first monomer of the embodiments; b) a second nucleic acid encoding the second monomer of the embodiments; and c) a third nucleic acid encoding the third monomer of the embodiments.

In further aspects, the invention provides expression vector compositions comprising: a) an expression vector comprising the first nucleic acids; b) an expression vector comprising the second nucleic acids; and c) an expression vector comprising the third nucleic acids.

In an additional aspect, the invention provides host cells comprising the expression vector compositions.

In a further aspect, the invention provides methods of producing the targeted IL-15/Rα heterodimeric Fc fusion proteins of the invention the method comprising: culturing the host cells under conditions where said targeted IL-15/Rα heterodimeric Fc fusion protein is expressed; and recovering said protein.

In an additional aspect, the invention provides methods of treating a cancer comprising administering to a patient in need thereof a pharmaceutical composition comprising the targeted IL-15/Rα heterodimeric Fc fusion proteins of the invention.

In a further aspect, the invention provides methods of treating a cancer comprising administering to a patient in need thereof a pharmaceutical composition comprising the targeted IL-15/Rα heterodimeric Fc fusion proteins of the invention in combination with an anti-PD-1 antibody including nivolumab or pembrolizumab.

BRIEF DESCRIPTION OF THE DRAWINGS

FIGS. 1A-1B depict the sequences for IL-15 and its receptors.

FIG. 2 depicts the sequences for PD-1 for both human and cynomolgus monkey to facilitate the development of antigen binding domains that bind to both for ease of clinical development.

FIGS. 3A-3E depict useful pairs of Fc heterodimerization variant sets (including skew and pI variants). There are variants for which there are no corresponding "monomer 2" variants; these are pI variants which can be used alone on either monomer.

FIG. 4 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein).

FIG. 5 depicts useful ablation variants that ablate FcγR binding (sometimes referred to as "knock outs" or "KO"

Figure 13A:
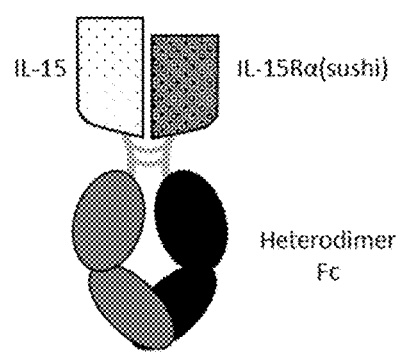
Figure 13B:
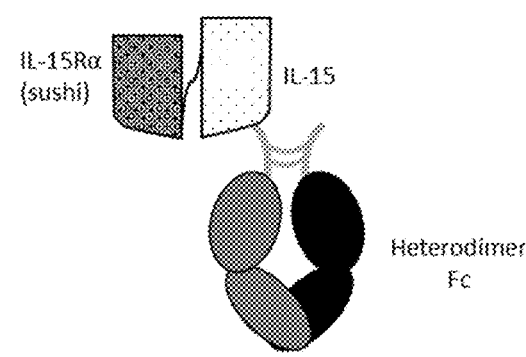
Figure 13C:
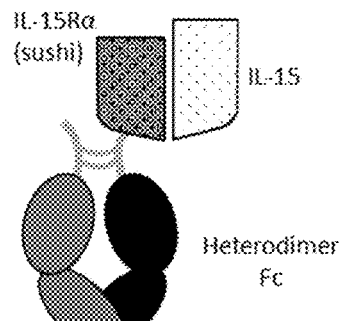
Figure 13D:
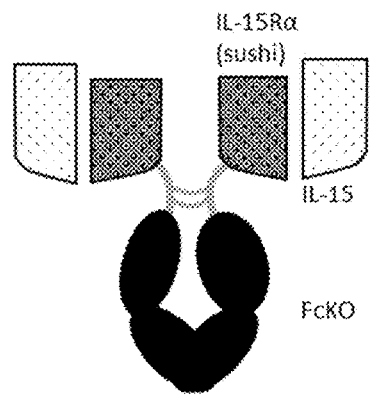
Figure 13E:
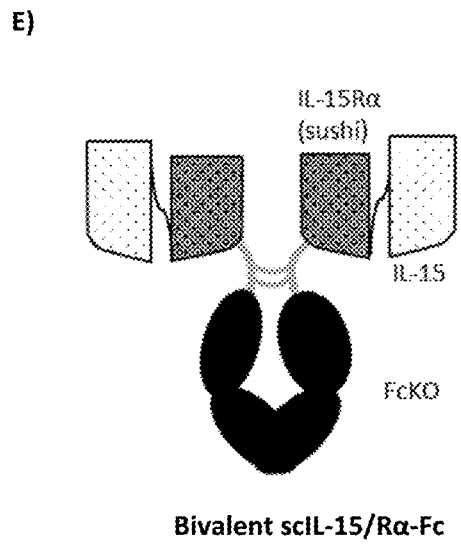
Figure 13F:
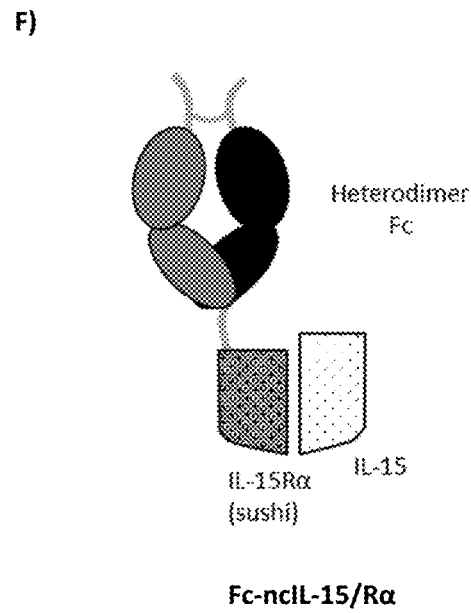
Figure 13G:
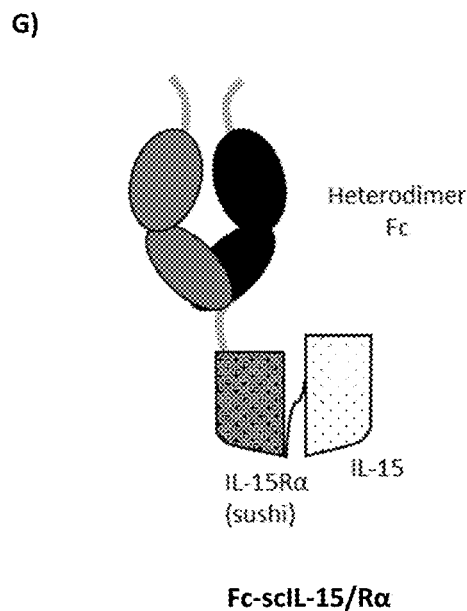

variants). Generally, ablation variants are found on both monomers, although in some cases they may be on only one monomer.

FIGS. 6A-6E show particularly useful embodiments of "non-cytokine" components of the IL-15/Rα-Fc fusion proteins of the invention.

FIGS. 7A-7F show particularly useful embodiments of "non-cytokine"/"non-Fv" components of the PD-1-targeted IL-15/Rα-Fc fusion proteins of the invention.

FIG. 8 depicts a number of exemplary variable length linkers for use in IL-15/Rα-Fc fusion proteins. In some embodiments, these linkers find use linking the C-terminus of IL-15 and/or IL-15Rα(sushi) to the N-terminus of the Fc region. In some embodiments, these linkers find use fusing IL-15 to the IL-15Rα(sushi).

FIGS. 9A-9C depicts a number of charged scFv linkers that find use in increasing or decreasing the pI of heterodimeric antibodies that utilize one or more scFv as a component. The (+H) positive linker finds particular use herein. A single prior art scFv linker with single charge is referenced as "Whitlow", from Whitlow et al., Protein Engineering 6(8):989-995 (1993). It should be noted that this linker was used for reducing aggregation and enhancing proteolytic stability in scFvs. In some embodiments, these linkers find use linking the C-terminus of IL-15 and/or IL-15Rα(sushi) to the N-terminus of the Fc region; and/or fusing IL-15 to the IL-15/Rα(sushi).

FIGS. 10A-10D show the sequences of several useful IL-15/Rα-Fc format backbones based on human IgG1, without the cytokine sequences (e.g., the Il-15 and/or IL-15Rα (sushi)). It is important to note that these backbones can also find use in certain embodiments of PD-1-targeted IL-15/Rα-Fc fusion proteins. Backbone 1 is based on human IgG1 (356E/358M allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes C220S on both chain, the S364K:L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chain, the S364K:L368E/K370S skew variants, the Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes C220S on both chain, the D401K: K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes C220S on both chain, the S364K/E357Q:L368D/K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S.

Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/N384D/Q418E/N421D pI variants on the chain with L368D/K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/P228R/N276K pI variants on the chain with S364K/E357Q skew variants and the E233P/L234V/L235A/G236del/S267K ablation variants on both chains.

As will be appreciated by those in the art and outlined below, these sequences can be used with any IL-15 and IL-15Rα(sushi) pairs outlined herein, including but not limited to IL-15/Rα-heteroFc, ncIL-15/Rα, and scIL-15/Rα, as schematically depicted in FIGS. 14A-14G. Additionally, any IL-15 and/or IL-15Rα(sushi) variants can be incorporated into these FIGS. 11A-11C backbones in any combination.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 11 shows the sequences of several useful PD-1-targeted IL-15/Rα-Fc fusion format backbones based on human IgG1, without the cytokine sequences (e.g. the Il-15 and/or IL-15Rα(sushi)) or VH, and further excluding cognate light chain backbones which are depicted in FIG. 12. Backbone 1 is based on human IgG1 (356E/358M allotype), and includes the S364K/E357Q:L368D/K370S skew variants, C220S and the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes the S364K/E357Q:L368D/K370S skew variants, the N208D/Q295E/N384D/Q418E/N421D pI variants on the chain with L368D/K370S skew variants, C220S in the chain with S364K/E357Q variants, and the E233P/L234V/L235A/G236del/S267K ablation variants on both chains. Backbone 3 is based on human IgG1 (356E/358M allotype), and includes the S364K/E357Q: L368D/K370S skew variants, the N208D/Q295E/N384D/Q418E/N421D pI variants on the chains with L368D/K370S skew variants, the Q196K/I199T/P217R/P228R/N276K pI variants on the chains with S364K/E357Q variants, and the E233P/L234V/L235A/G236del/S267K ablation variants on both chains.

In certain embodiments, these sequences can be of the 356D/358L allotype. In other embodiments, these sequences can include either the N297A or N297S substitutions. In some other embodiments, these sequences can include the M428L/N434S Xtend mutations. In yet other embodiments, these sequences can instead be based on human IgG4, and include a S228P (EU numbering, this is S241P in Kabat) variant on both chains that ablates Fab arm exchange as is known in the art. In yet further embodiments, these sequences can instead be based on human IgG2. Further, these sequences may instead utilize the other skew variants, pI variants, and ablation variants depicted in FIGS. 4, 5, and 6A-6E.

Figure 34A:
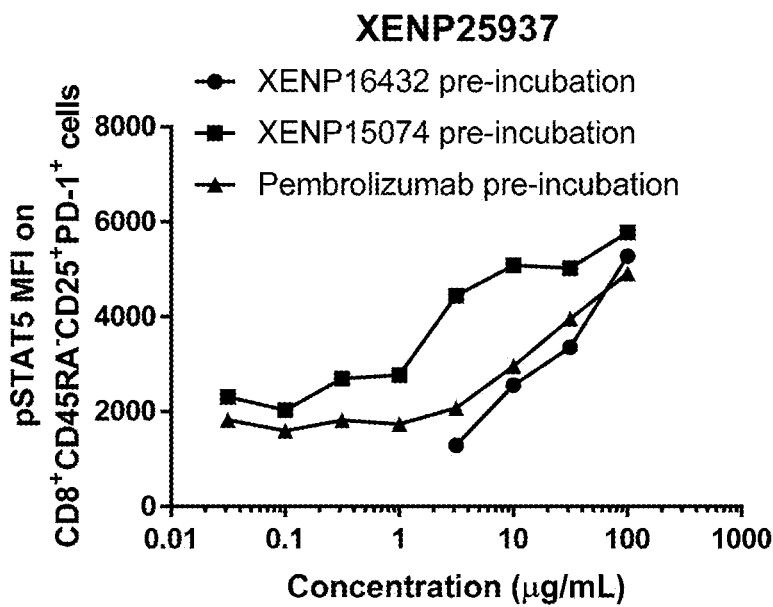
Figure 34B:
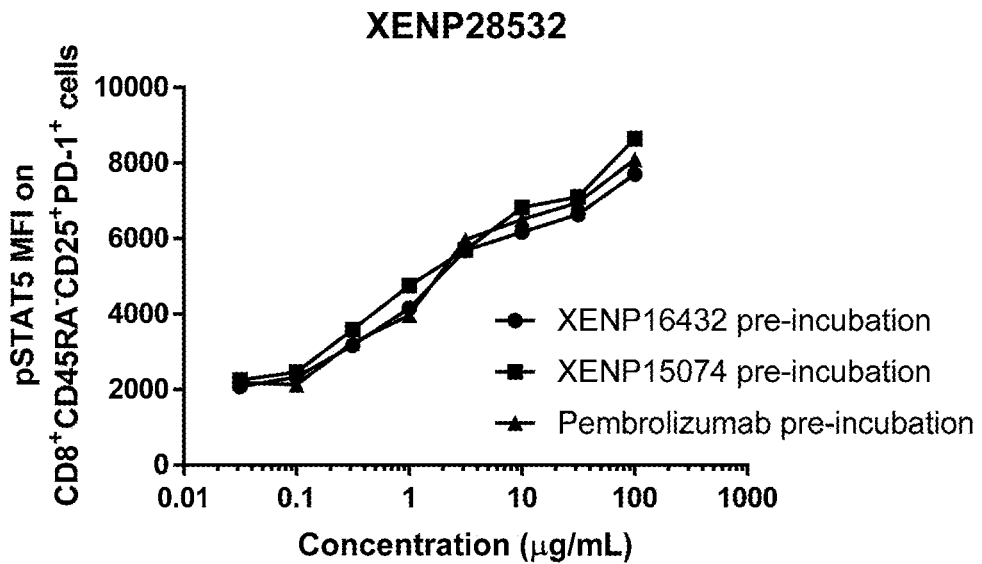

As will be appreciated by those in the art and outlined below, these sequences can be used with any IL-15 and IL-15Rα(sushi) pairs outlined herein, including but not limited to scIL-15/Rα, ncIL-15/Rα, and dsIL-15Rα, as schematically depicted in FIGS. 34A-34B. Further as will be appreciated by those in the art and outlined below, any IL-15 and/or IL-15Rα(sushi) variants can be incorporated in these backbones. Furthermore as will be appreciated by those in the art and outlined below, these sequences can be used with any VH and VL pairs outlined herein, including either a scFv or a Fab.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 12 depicts the "non-Fv" backbone of cognate light chains (i.e., constant light chain) which find use in PD-1-targeted IL-15/Rα-Fc fusion proteins of the invention.

FIGS. 13A-13G depict several formats for the "untargeted" IL-15/Rα-Fc fusion proteins of the present invention. IL-15Rα Heterodimeric Fc fusion or "IL-15/Rα-heteroFc" (FIG. 13A) comprises IL-15 recombinantly fused to one side of a heterodimeric Fc and IL-15Rα(sushi) recombinantly fused to the other side of a heterodimeric Fc. The IL-15 and IL-15Rα(sushi) may have a variable length Gly-Ser linker between the C-terminus and the N-terminus of the Fc region. Single-chain IL-15/Rα-Fc fusion or "scIL-15/Rα-Fc" (FIG. 13B) comprises IL-15Rα(sushi) fused to IL-15 by a variable length linker (termed a "single-chain" IL-15/IL-15Rα(sushi) complex or "scIL-15/Rα") which is then fused to the N-terminus of a heterodimeric Fc-region, with the other side of the molecule being "Fc-only" or "empty Fc". Non-covalent IL-15/Rα-Fc or "ncIL-15/Rα-Fc" (FIG. 13C) comprises IL-15Rα(sushi) fused to a heterodimeric Fc region, while IL-15 is transfected separatedly so that a non-covalent IL-15/Rα complex is formed, with the other side of the molecule being "Fc-only" or "empty Fc". Bivalent non-covalent IL-15/Rα-Fc fusion or "bivalent ncIL-15/Rα-Fc" (FIG. 13D) comprises IL-15Rα(sushi) fused to the N-terminus of a homodimeric Fc region, while IL-15 is transfected separately so that a non-covalent IL-15/Rα complex is formed. Bivalent single-chain IL-15/Rα-Fc fusion or "bivalent scIL-15/Rα-Fc" (FIG. 13E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Fc-non-covalent IL-15/Rα fusion or "Fc-ncIL-15/Rα" (FIG. 13F) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". Fc-single-chain IL-15/Rα fusion or "Fc-scIL-15/Rα" (FIG. 13G) comprises IL-15 fused to IL-15Rα(sushi) by a variable length linker (termed a "single-chain" IL-15/IL-15Rα(sushi) complex or "scIL-15/Rα") which is then fused to the C-terminus of a heterodimeric Fc region, with the other side of the molecule being "Fc-only" or "empty Fc".

FIG. 14 depicts sequences of illustrative IL-15/Rα-Fc fusion proteins of the untargeted "IL-15/Rα-heteroFc" format. IL-15 and IL-15Rα(sushi) are underlined, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, and Fc regions.

FIG. 15 depicts sequences of illustrative IL-15/Rα-Fc fusion proteins of the untargeted "scIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, and Fc regions.

FIG. 16 depicts sequences of illustrative IL-15/Rα-Fc fusion proteins of the untargeted "ncIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, and Fc regions.

Figure 17A:
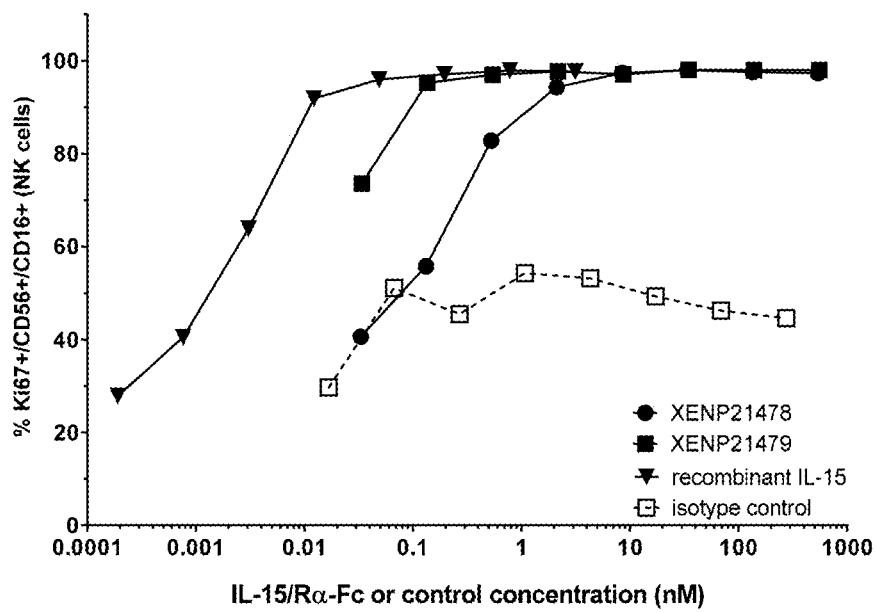
Figure 17B:
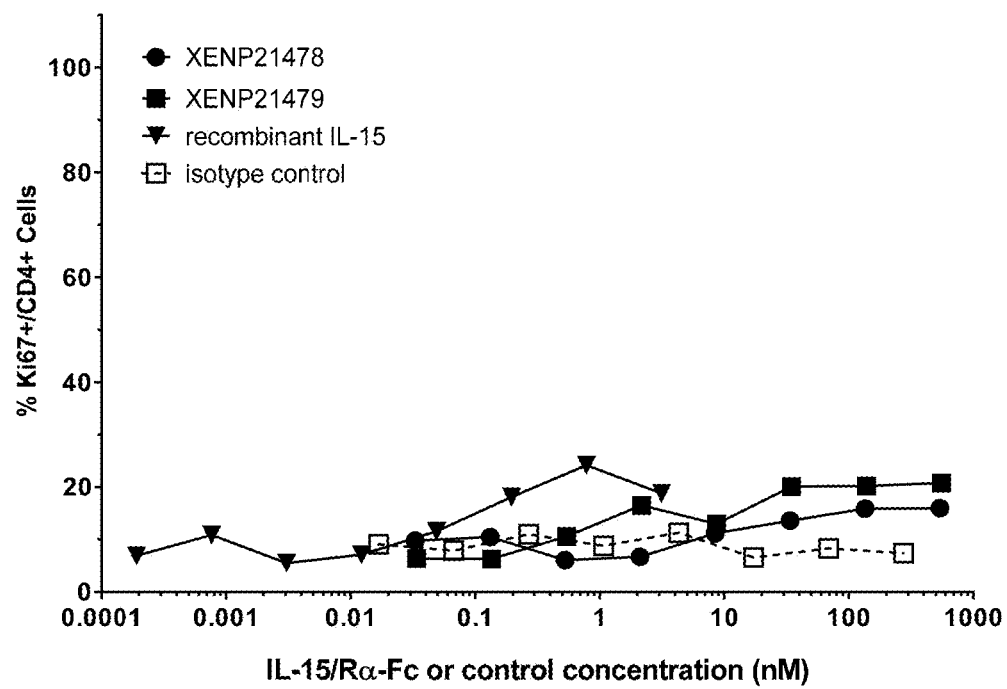
Figure 17C:
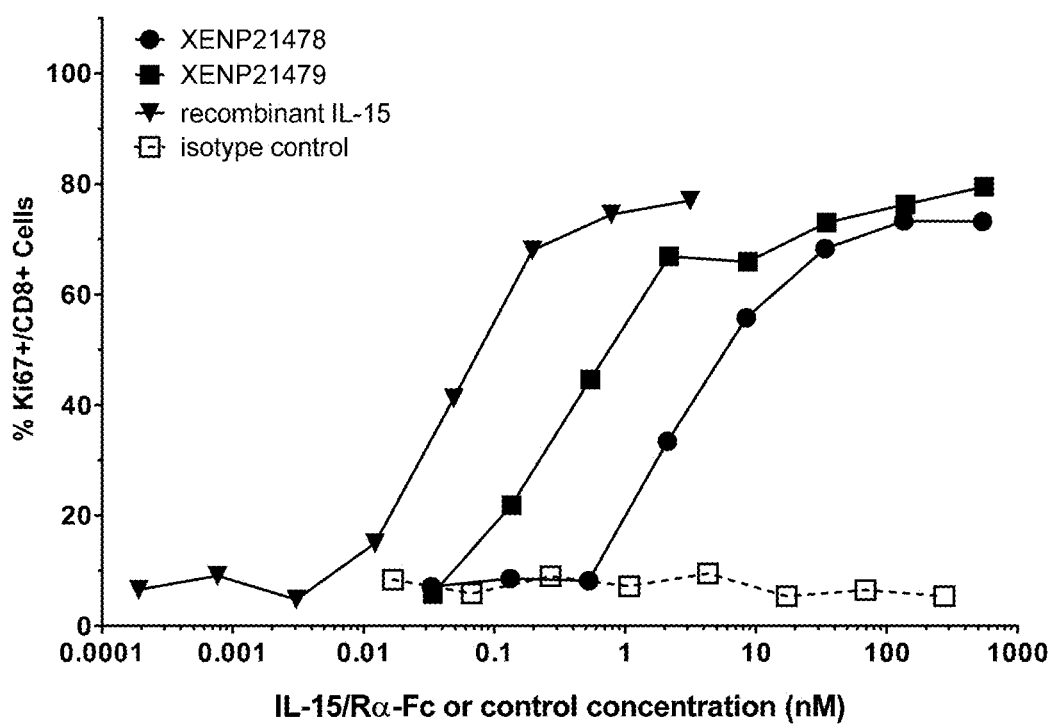

FIGS. 17A-17C depicts the induction of A) NK ($CD56^+$/$CD16^+$) cells, B) $CD4^+$ T cells, and C) $CD8^+$ T cells proliferation by illustrative IL-15/Rα-Fc fusion proteins of scIL-15/Rα-Fc format (XENP21478) and ncIL-15/Rα-Fc format (XENP21479) based on Ki67 expression as measured by FACS.

Figure 18:
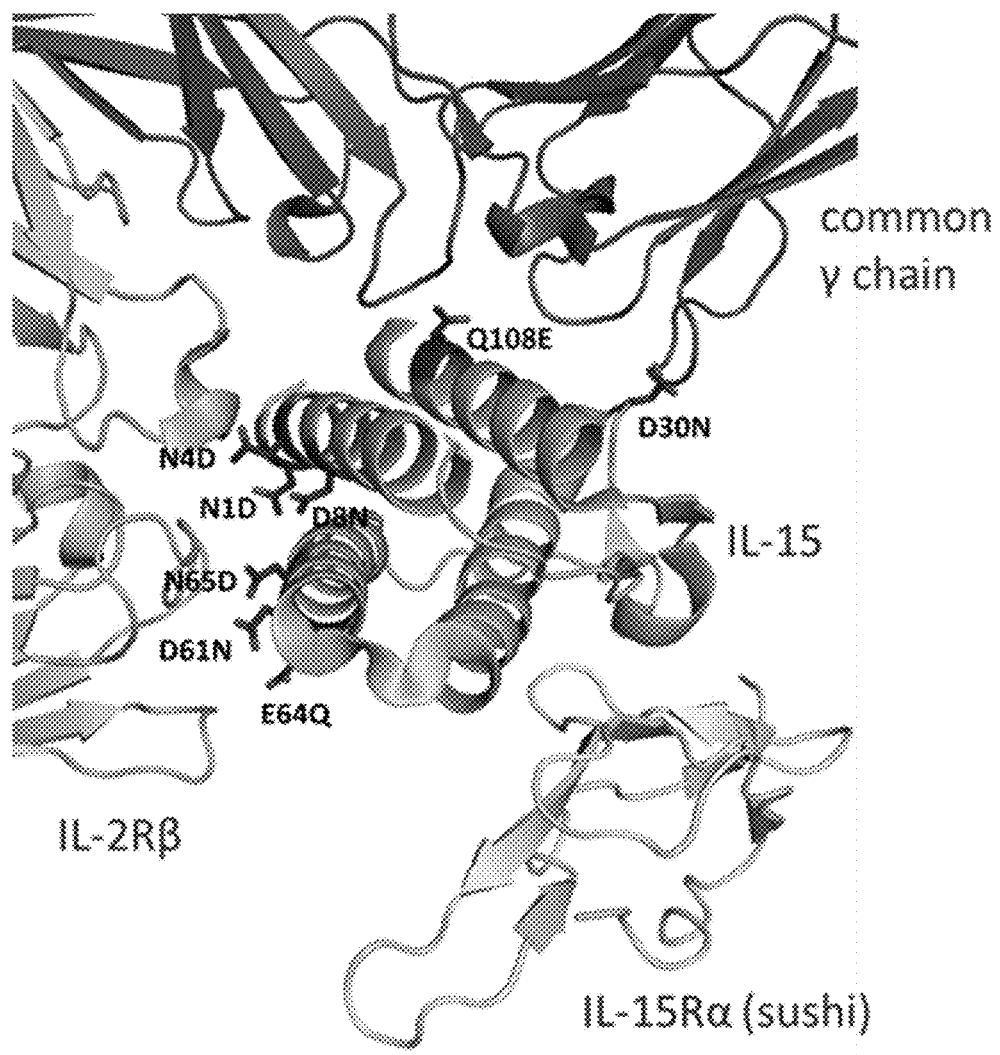

FIG. 18 depicts the structure of IL-15 complexed with IL-15Rα, IL-2Rβ, and common gamma chain. Locations of substitutions designed to reduce potency are shown.

FIGS. 19A-19C depicts sequences for illustrative IL-15 variants engineered with the aim to reduce potency. Included within each of these variant IL-15 sequences are sequences that are 90, 95, 98 and 99% identical (as defined herein) to the recited sequences, and/or contain from 1, 2, 3, 4, 5, 6, 7, 8, 9 or 10 additional amino acid substitutions. As will be clear to those skilled in the art, the IL-15 variants can be used in any of the IL-15/Rα-Fc fusion and PD-1-targeted IL-15/Rα-Fc fusion proteins described herein.

FIG. 20 depicts sequences of illustrative IL-15/Rα-Fc fusion proteins (e.g. untargeted constructs) of the "untargeted IL-15/Rα-heteroFc" format comprising IL-15 variants engineered with the aim to reduce potency. IL-15 and IL-15Rα(sushi) are underlined, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, and Fc regions.

FIG. 21A-21B depicts sequences of illustrative IL-15/Rα-Fc fusion proteins of the untargeted "scIL-15/Rα-Fc" format comprising IL-15 variants engineered with the aim to reduce potency. IL-15 and IL-15Rα(sushi) are underlined, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, and Fc regions.

Figure 22A:
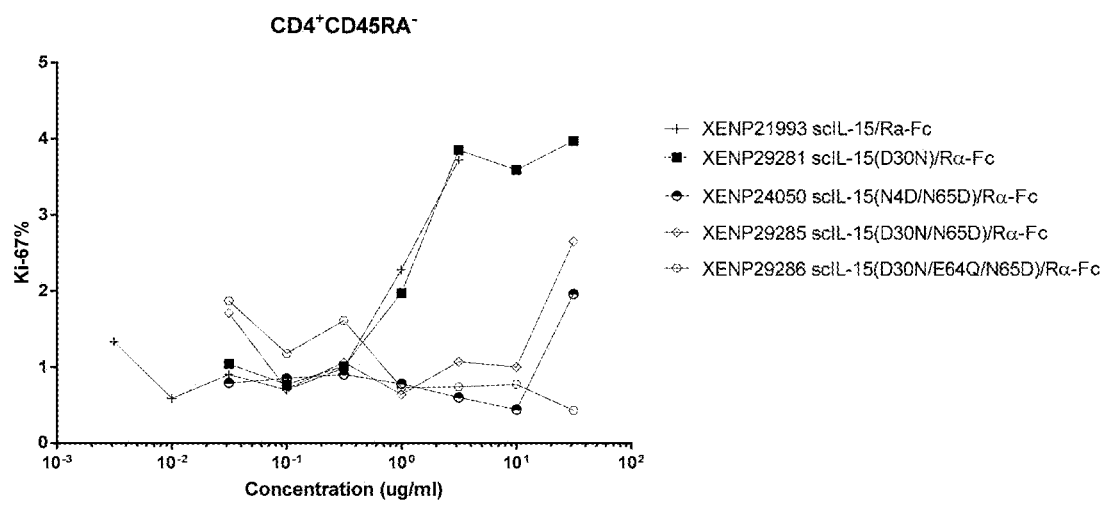
Figure 22B:
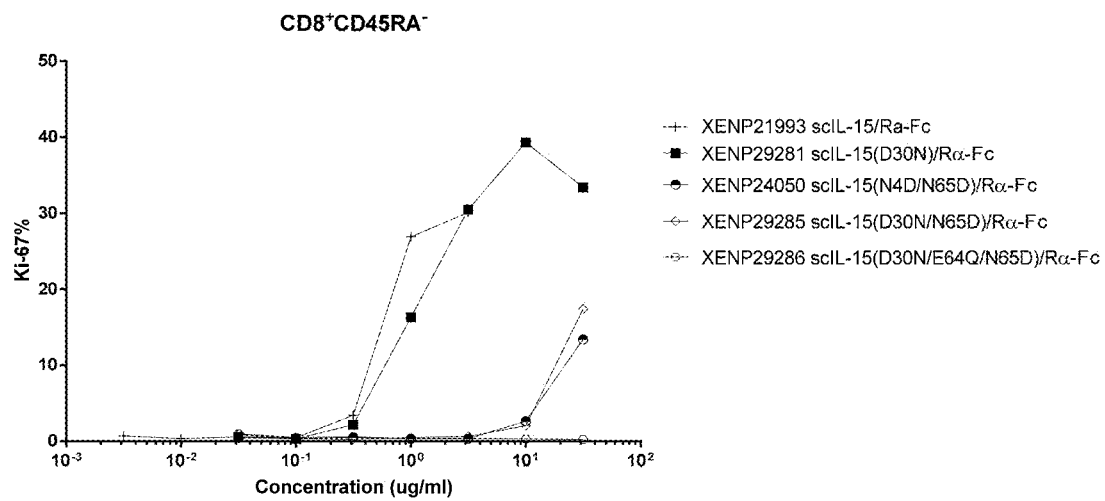

FIG. 22A-22B depicts percentage of A) CD4$^+$CD45RA$^-$ and b) CD8$^+$CD45RA$^-$ cells expressing Ki67 following incubation with the indicated test articles.

FIG. 23 depicts the amino acid sequences of XENP15074 (a bivalent anti-RSV mAb based on motavizumab and human IgG1 Fc with E233P/L234V/L235A/G236del/S267K substitutions). CDRs are underlined and slashes indicate the border(s) of the variable regions.

FIG. 24 depicts the amino acid sequences of A) XENP16432 (a bivalent anti-PD-1 mAb based on nivolumab and human IgG1 Fc with E233P/L234V/L235A/G236del/S267K substitutions) B) XENP21641 (pembrolizumab), and C) XENP28437 (a bivalent anti-PD-1 mAb based on pembrolizumab and human IgG1 Fc with E233P/L234V/L235A/G236del/S267K substitutions). CDRs are underlined and slashes indicate the border(s) of the variable regions.

FIG. 25 depicts the sequences for XENP21575, a chimeric and humanized anti-PD-1 antibody based on the variable regions of hybridoma clone 1C11 and human IgG1 with E233P/L234V/L235A/G236del/S267K substitutions in the heavy chain. The CDRs are underlined, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-15/Rα-Fc fusion proteins of the invention.

FIG. 26 depicts the sequences for illustrative humanized variants of anti-PD-1 mAb A and mAb B in bivalent human IgG1 format with E233P/L234V/L235A/G236del/S267K substitutions in the heavy chain. The CDRs are underlined, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. As will be appreciated by those in the art, the VH and VL domains can be formatted as Fab or scFvs for use in the PD-1-targeted IL-15/Rα-Fc fusion proteins of the invention.

FIG. 27 depicts epitope binning of XENP16432 (a bivalent anti-PD-1 mAb based on nivolumab), XENP21461 (pembrolizumab), chimeric mAb A (chmAb A), chimeric mAb B (chmAb B), and a 1C11-based mAb as indicated by normalized BLI-response Octet. Normalized BLI-response greater than 0.5 indicate that an antibody pair does not bin to the same epitope.

FIG. 28A-28H depicts several formats for the PD-1-targeted IL-15/Rα-Fc fusion proteins of the present invention. The "scIL-15/RαxscFv" format (FIG. 28A) comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc. The "scFvxncIL-15/Rα" format (FIG. 28B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. The "scIL-15/RαxFab" format (FIG. 28C) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. The "ncIL-15/RαxFab" format (FIG. 28D) comprises a VH fused to the N-terminus of a heterodimeric Fc-region, with IL-15Rα (sushi) fused to the other side of the heterodimeric Fc, while a corresponding light chain is transfected separately so as to form a Fab with the VH, and while IL-15 is transfected separately so that a non-covalent IL-15/Rα complex is formed. The "mAb-scIL-15/Rα" format (FIG. 28E) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form a Fabs with the VHs. The "mAb-ncIL-15/Rα" format (FIG. 28F) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while IL-15 is transfected separately so that a non-covalent IL-15/Rα complex is formed. The "central-IL-15/Rα" format (FIG. 28G) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. The "central-scIL-15/Rα" format (FIG. 28H) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs.

FIG. 29 depicts sequences of illustrative [C]PD-1-targeted IL-15/Rα-Fc fusion proteins of the "scIL-15/RαxFab" format. The CDRs are in bold. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are italicized, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, variable regions, and constant/Fc regions. As will be clear to those skilled in the art, each of the targeted IL-15/Rα-Fc fusion proteins described can include or exclude Xtend Fc (M428L/N434S).

FIG. 30 depicts sequences of illustrative [NC]PD-1-targeted IL-15/Rα-Fc fusion proteins of the "scIL-15/RαxFab" format. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-15 and IL-15Rα(sushi) are italicized, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, variable regions, and constant/Fc regions. As will be clear to those skilled in the art, each of the targeted IL-15/Rα-Fc fusion proteins described can include or exclude Xtend Fc (M428L/N434S).

FIG. 31A-31D depicts the sequences of control RSV-targeted IL-15/Rα-Fc fusions. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. IL-15 and IL-15Rα(sushi) are italicized, linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, variable regions, and constant/Fc regions. As will be clear to those skilled in the art, each of the targeted IL-15/Rα-Fc fusion proteins described can also exclude or include Xtend Fc (M428L/N434S).

Figure 32A:
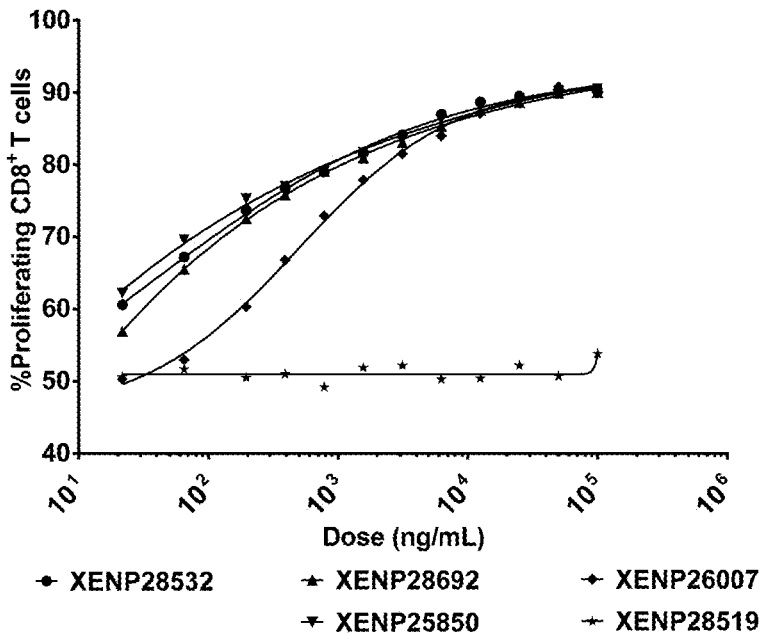
Figure 32B:
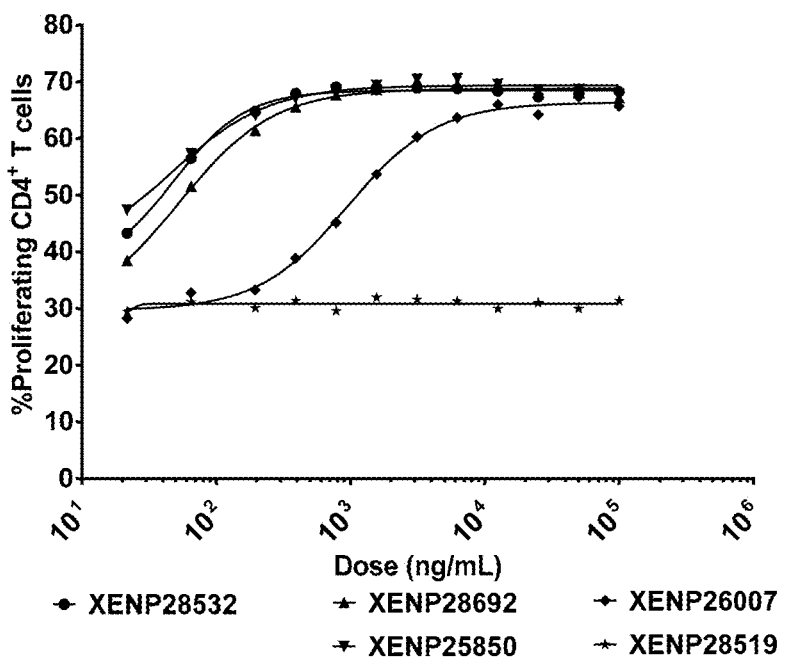

FIG. 32A-32B depicts the proliferation of A) CD8$^+$ T cells and B) CD4$^+$ T cells following incubation with PD-1-targeted IL-15/Rα-Fc fusions (XENP28532, XENP28692, and XENP25850), as well as control RSV-targeted IL-15/Rα-Fc fusion (XENP26007) and anti-PD-1 mAb (XENP28519).

Figure 33A:
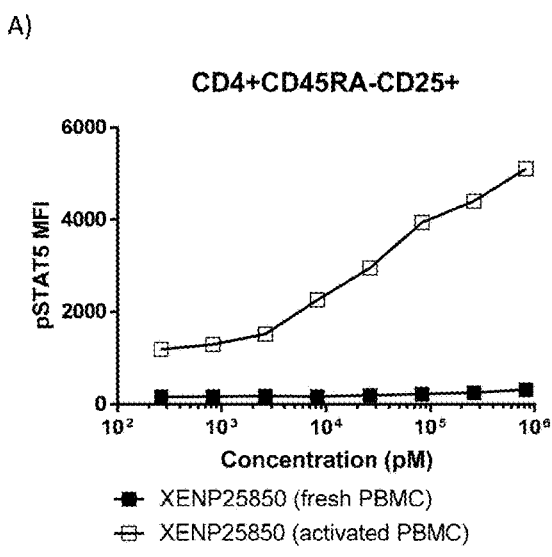
Figure 33B:
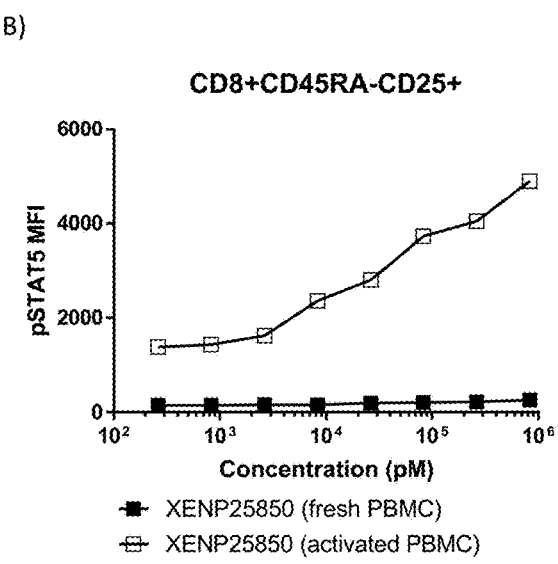

FIG. 33A-33B depicts induction of STAT5 phosphorylation on A) CD4$^+$CD45RA$^-$ CD25$^+$ and B) CD8$^+$CD45RA$^-$CD25$^+$ by XENP25850 (an illustrative PD-1-targeted IL-15/Rα-Fc fusion). Fresh cells are indicated in dotted lines, and activated cells are indicated in solid lines. Fresh cells are all CD25$^-$.

FIG. 34A-34B depicts induction of STAT5 phosphorylation on CD8$^+$CD45RA$^-$ CD25$^+$PD-1$^+$ T cells by A) [C]PD-1-targeted IL-15/Rα-Fc fusion XENP25937 and B) [NC]PD-1-targeted IL-15/Rα-Fc fusion XENP28532 following pre-incubation with either nivolumab-based XENP16432, pembrolizumab, or anti-RSV mAb XENP15074.

Figure 35:
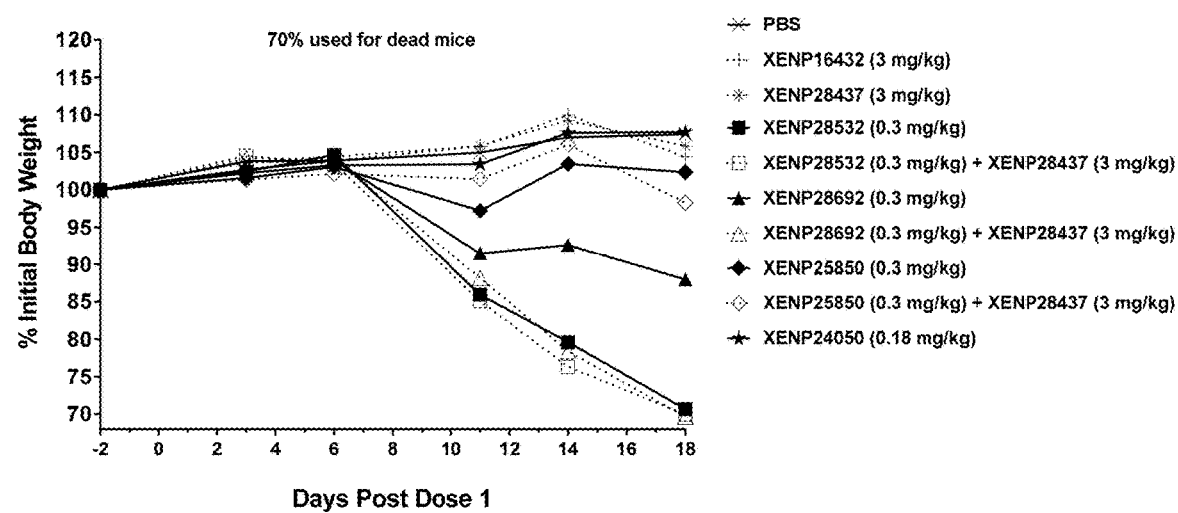

FIG. 35 depicts change in body weight huPBMC-engrafted NSG mice over time (as a percentage of initial body weight) after dosing with the indicated test articles.

Figure 36A:
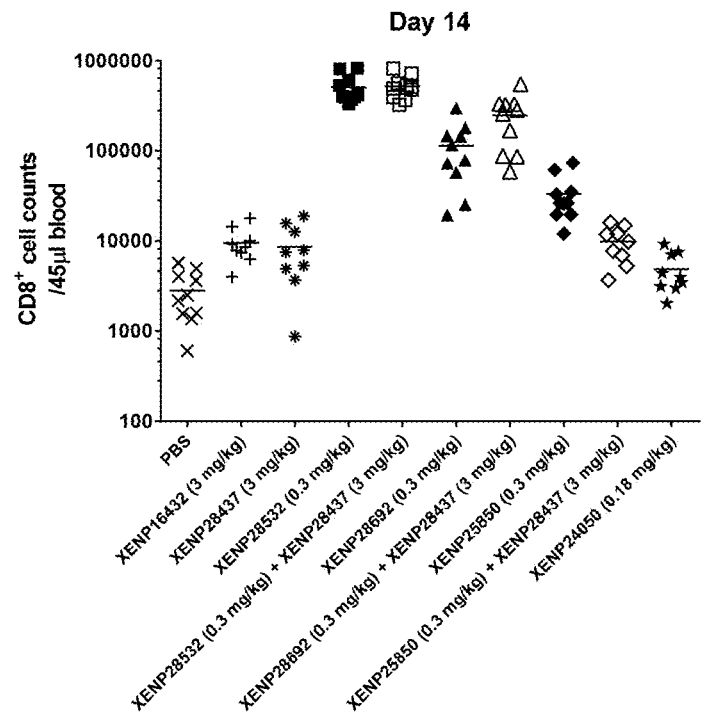
Figure 36B:
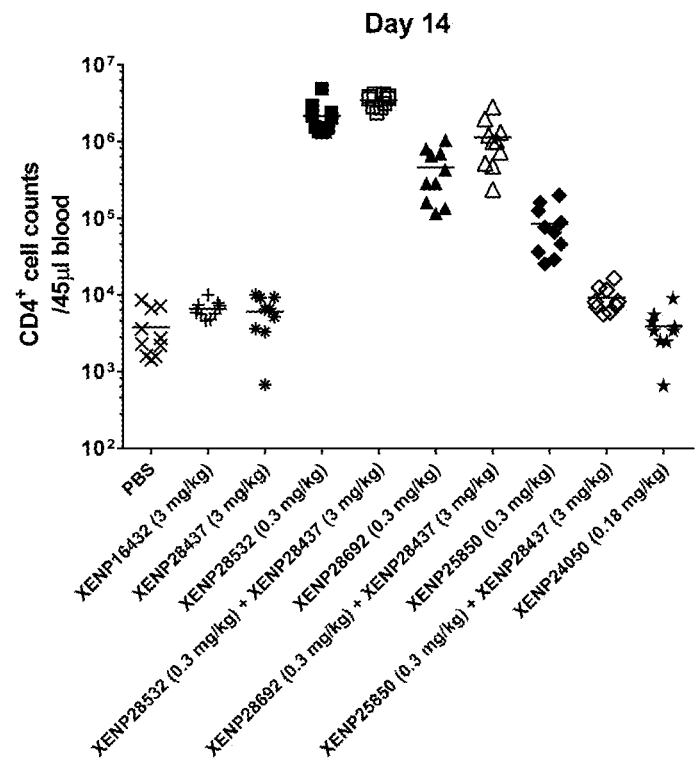

FIG. 36A-36B depicts A) CD8$^+$ T cell counts and B) CD4$^+$ T cell counts on Day 14 after the first dose of the indicated test articles in human PBMC-engrafted NSG mice.

Figure 37A:
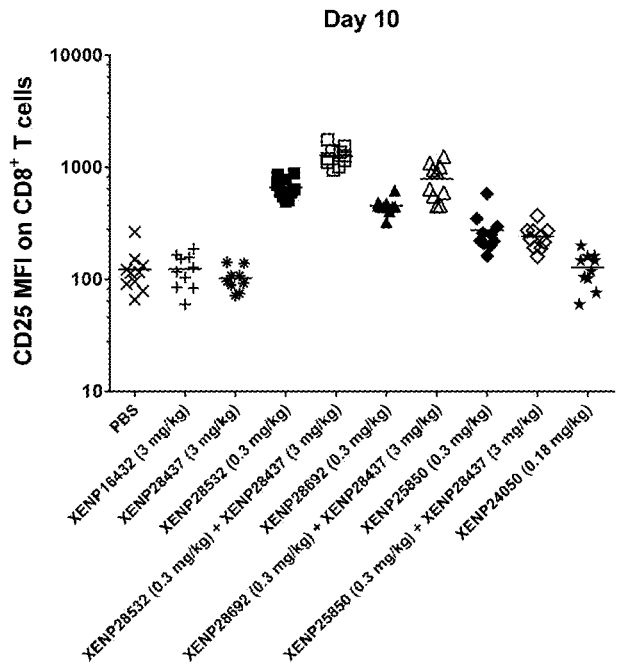
Figure 37B:
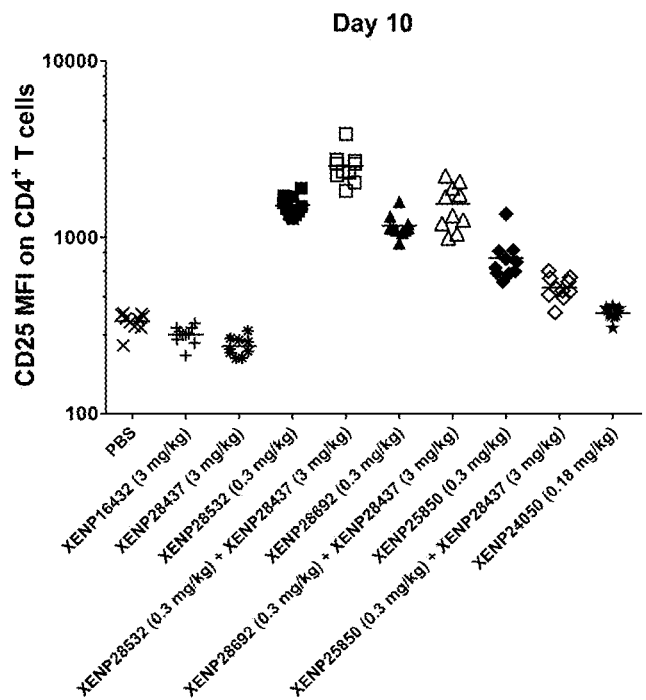

FIG. 37A-37B depicts CD25 expression on A) CD8$^+$ T cells and B) CD4$^+$ T cells on Day 10 after the first dose of the indicated test articles in human PBMC-engrafted NSG mice.

Figure 38:
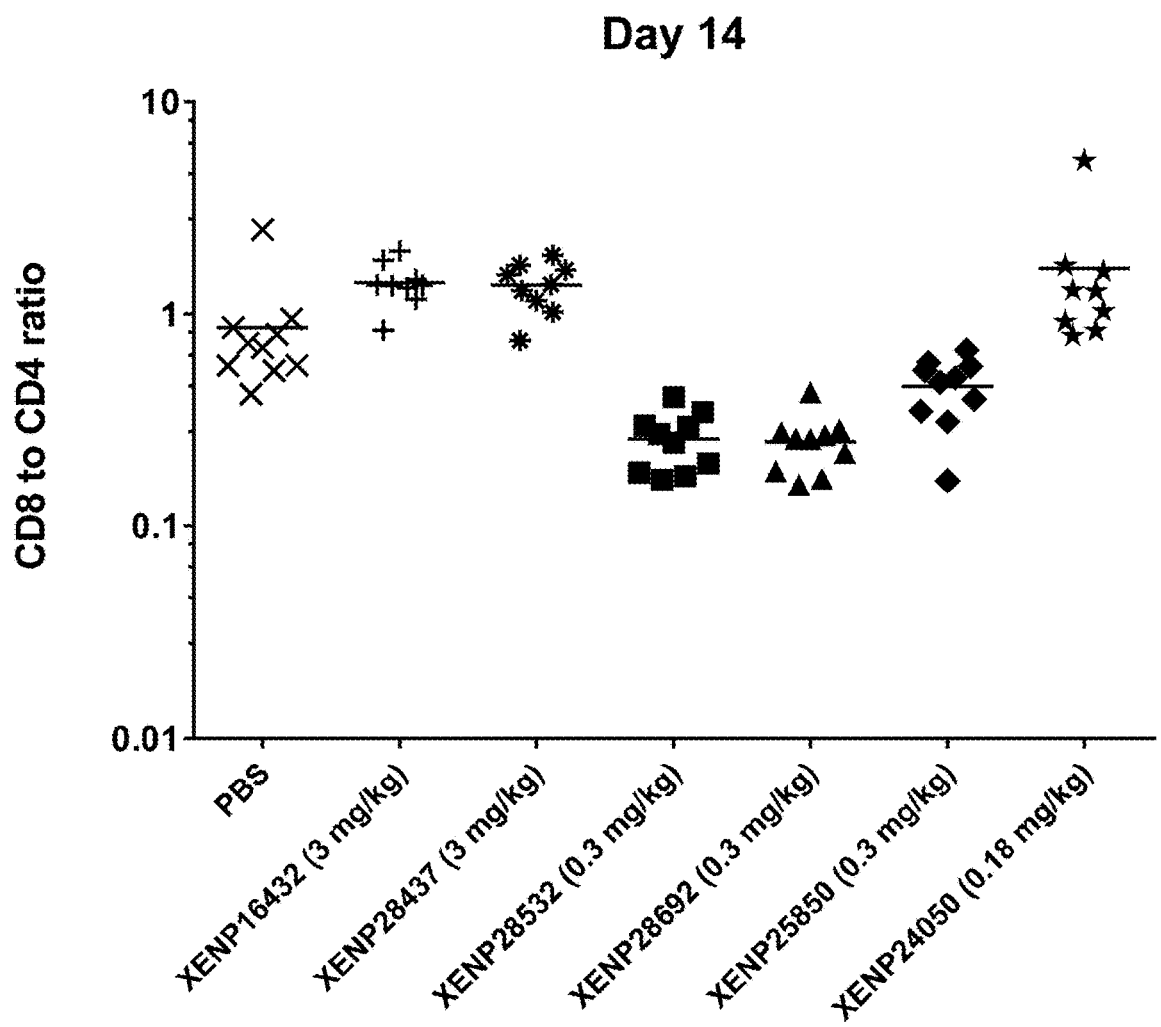

FIG. 38 depicts the ratio of CD8$^+$ T cells to CD4$^+$ T cells on Day 10 after the first dose of the indicated test articles in human PBMC-engrafted NSG mice.

Figure 39A:
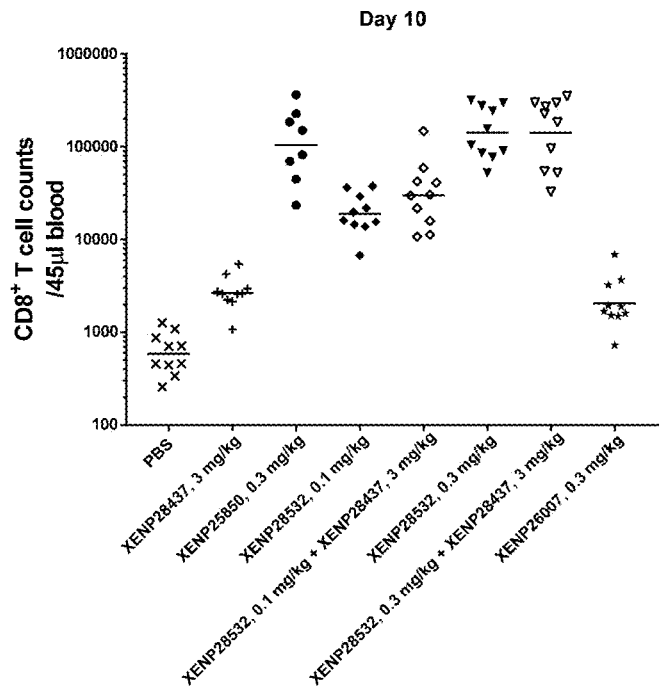
Figure 39B:
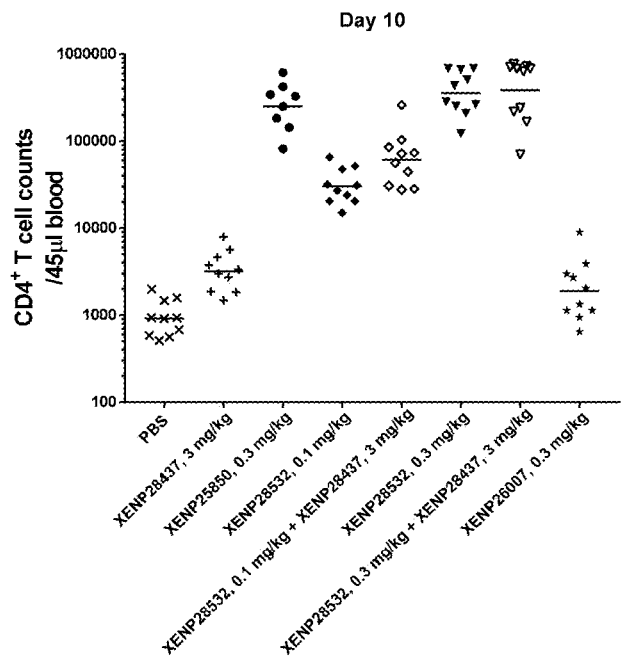

FIG. 39A-39B depicts A) CD8$^+$ T cell counts and B) CD4$^+$ T cell counts on Day 10 after the first dose of the indicated test articles in human PBMC-engrafted NSG mice.

Figure 40A:
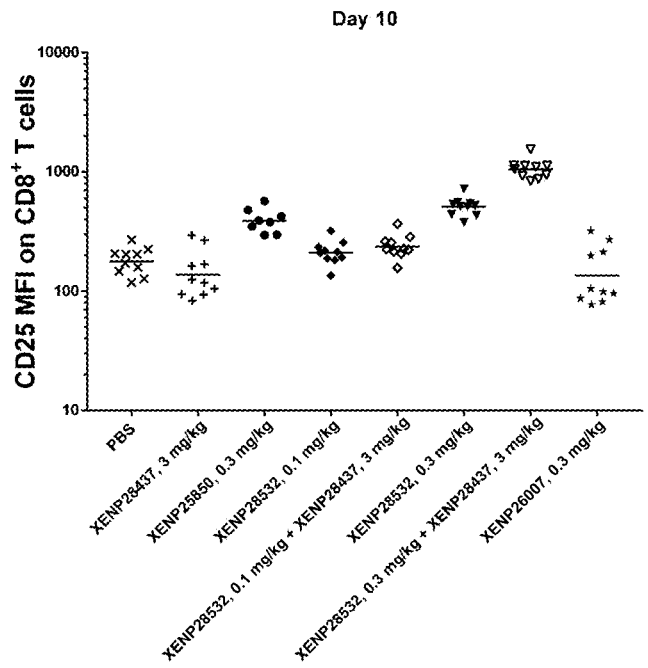
Figure 40B:
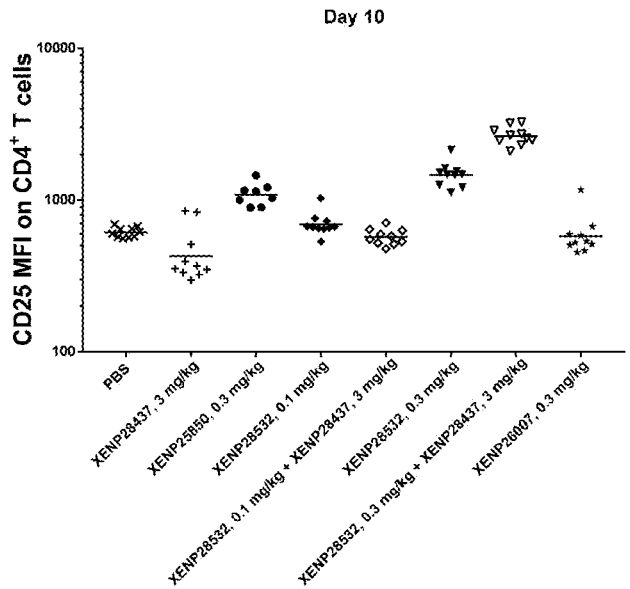

FIG. 40A-40B depicts CD25 expression on A) CD8$^+$ T cells and B) CD4$^+$ T cells on Day 10 after the first dose of the indicated test articles in human PBMC-engrafted NSG mice.

Figure 41:
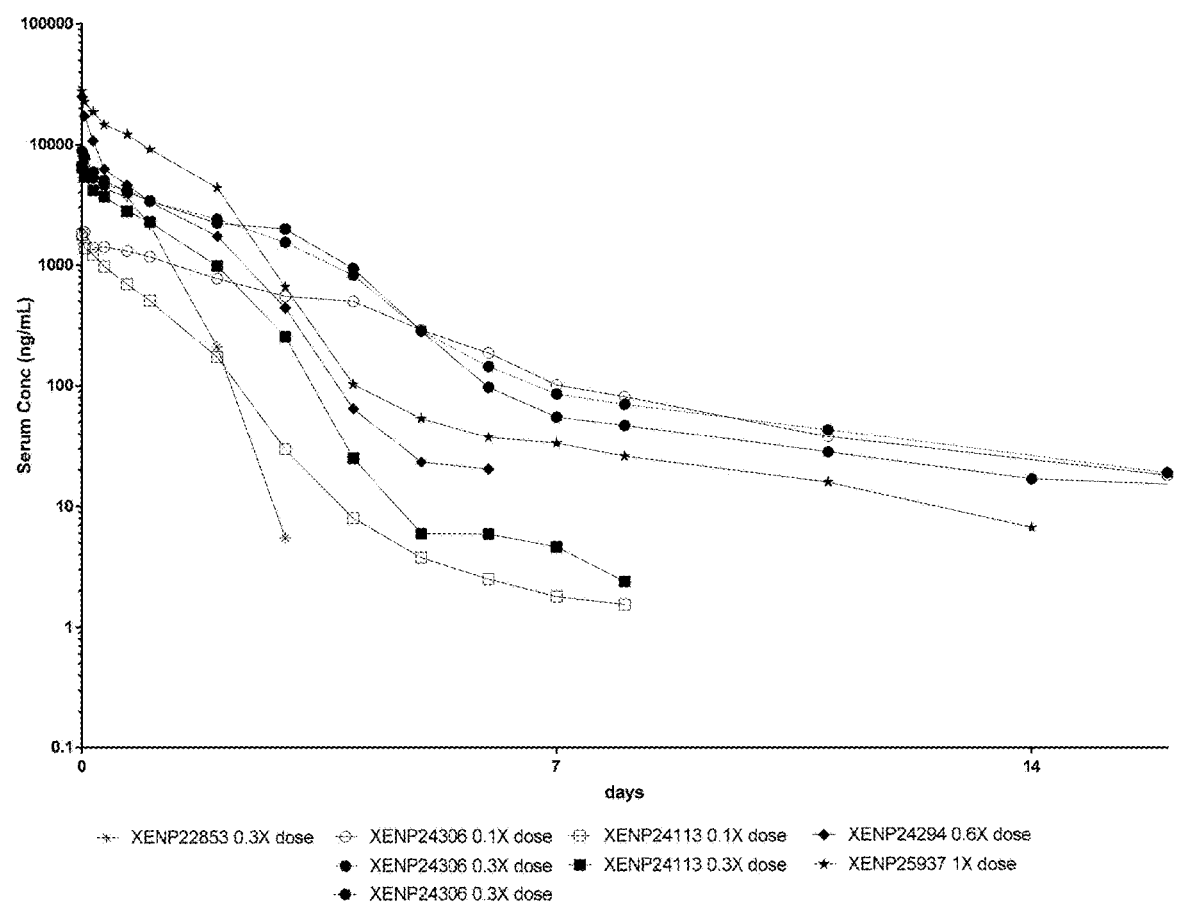

FIG. 41 depicts the serum concentration of the indicated test articles over time in cynomolgus monkeys following a first dose at the indicated relative concentrations. FIG. 42

FIG. 42 depicts the sequences of XENP29484 and XENP29485, illustrative [NC]PD-1-targeting IL-15/Rα-Fc fusion proteins having the IL-15(D30N/N65D) variant. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. IL-15 and IL-15Rα(sushi) are italicized, linkers are double underlined (although as will be appreciated by those in the art, the linkers can be replaced by other linkers, some of which are depicted in the Figures, and slashes (/) indicate the border(s) between IL-15, IL-15Rα, linkers, variable regions, and constant/Fc regions.

FIG. 43A-43X depicts the variable heavy and variable light chains for additional illustrative anti-PD-1 ABDs that do not compete with nivolumab nor pembrolizumab. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems.

Figure 44A:
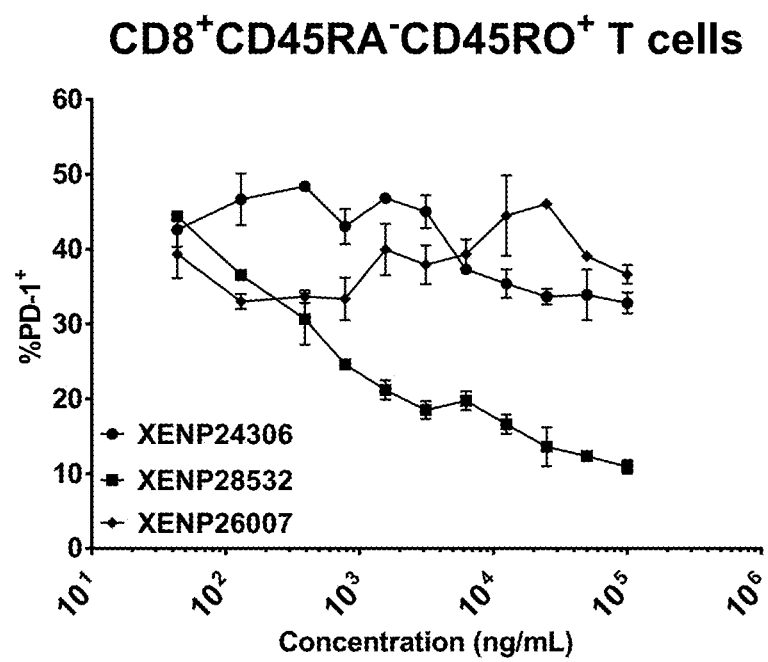
Figure 44B:
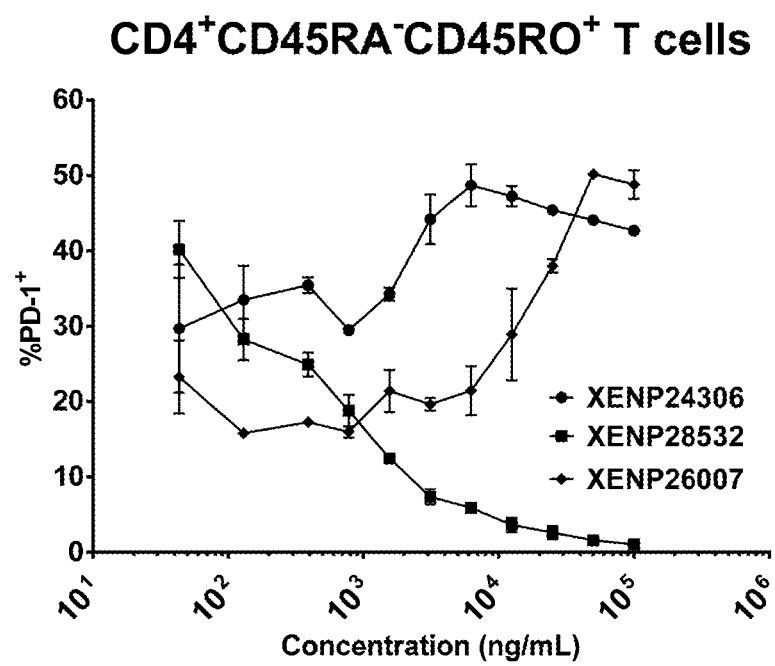

FIG. 44A-44B depicts the percentage of PD-1$^+$ A) CD8$^+$CD45RA$^-$CD45RO$^+$ T cells and B) CD4$^+$CD45RA$^-$CD45RO$^+$ T cells following treatment with PD-1-targeted IL-15/Rα-Fc fusion XENP28532 as well as control XENP24306 (untargeted IL-15/Rα-Fc fusion) and XENP26007 (RSV-targeted IL-15/Rα-Fc fusion).

FIG. 45 depicts the sequences for illustrative humanized variants of anti-PD-1 mAb C in bivalent human IgG1 format with E233P/L234V/L235A/G236del/S267K substitutions in the heavy chain. The CDRs are underlined, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the VH and VL domains using other numbering systems. As will be appreciated by those in the art, the VH and VL domains can be formatted as Fab or scFvs for use in the PD-1-targeted IL-15/Rα-Fc fusion proteins of the invention.

FIG. 46 depicts the affinity of XENP28536, XENP28537, XENP28538, XENP28539, and XENP28519 for human and cynomolgus PD-1 as determined by Octet.

FIG. 47 depicts epitope binning of XENP16432 (a bivalent anti-PD-1 mAb based on nivolumab), XENP21461 (pembrolizumab), and chimeric mAb C (chmAb C). Normalized BLI-response greater than 0.5 indicate that an antibody pair does not bin to the same epitope. The data indicate that anti-PD-1 mAb C does not bin to the same epitope as nivolumab and pembrolizumab.

FIG. 48A-48C depicts sequences of illustrative [NC]PD-1-targeted IL-15/Rα-Fc fusion proteins of the "scIL-15/Rα× Fab" format comprising PD-1 targeting arm based on mAb C and various IL-15 potency variants. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Linkers are double underlined (although as will be appreciated by those in the art, the linkers can be replaced by other linkers, some of which are depicted in FIGS. 65 and 66), and slashes (/) indicate the border(s) between IL-15, IL-15Rα, linkers, variable regions, and constant/Fc regions. As will be clear to those skilled in the art, each of the PD-1-targeted IL-15/Rα-Fc fusion proteins described can also exclude or include Xtend Fc (M428L/N434S).

FIG. 49A-49C depicts sequences of illustrative [NC]PD-1-targeted IL-15/Rα-Fc fusion proteins of the "scIL-15/Rαx Fab" format comprising PD-1 targeting arm based on mAb C and various IL-15 potency variants, additionally comprising Xtend Fc (M428L/N434S). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Linkers are double underlined (although as will be appreciated by those in the art, the linkers can be replaced by other linkers, some of which are depicted in FIGS. 65 and 66), and slashes (/) indicate the border(s) between IL-15, IL-15Rα, linkers, variable regions, and constant/Fc regions.

FIG. 50 depicts induction of A) CD8$^+$ T cells and B) CD4$^+$ T cells proliferation by [NC]PD-1-targeted IL-15/Rα-Fc fusions (and controls) as indicated by percentage proliferating cells (determined based on CFSE dilution). The data show that the [NC]PD-1-targeted IL-15/Rα-Fc fusions were more potent in inducing proliferation of CD4$^+$ T cells in comparison to untargeted IL-15(D30N/E64Q/N65D)/Rα-Fc fusion (as well as control RSV-targeted IL-15/Rα-Fc fusion).

Figure 51:
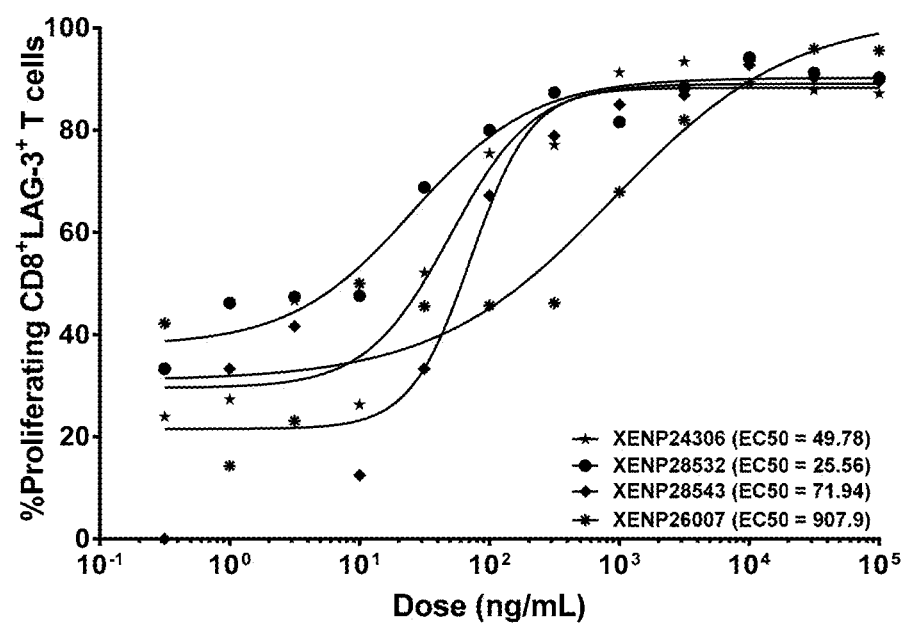

FIG. 51 depicts induction of LAG-3-positive CD8$^+$ T cells by [NC]PD-1-targeted IL-15/Rα-Fc fusions (and controls) as indicated by percentage proliferating cells (determined based on CFSE dilution). The data show that XENP28532 was more potent in inducing proliferation of CD8$^+$LAG-3$^+$ T cells in comparison to untargeted IL-15 (D30N/E64Q/N65D)/Rα-Fc fusion (as well as control RSV-targeted IL-15/Rα-Fc fusion). Additionally, XENP28543 was more potent in inducing CD8$^+$LAG-3$^+$ T cell proliferation than bulk CD8$^+$ T cell proliferation (EC50 276.8 vs. 71.94). Collectively, this supports the notion that the [NC] PD-1-targeted IL-15/Rα-Fc fusions may be selective for T cells expressing checkpoints such as those that would be found in the tumor environment.

Figure 52:
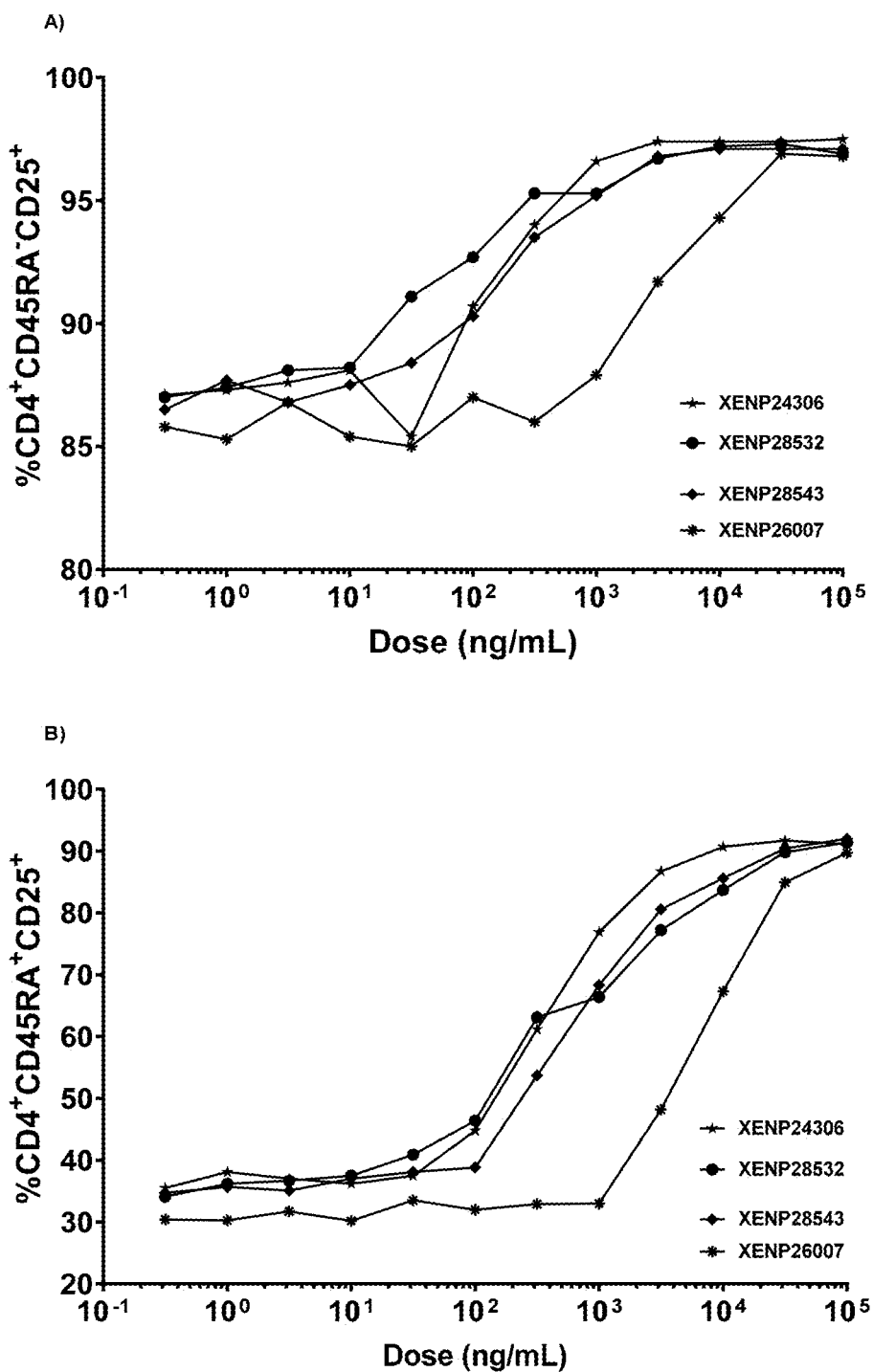

FIG. 52 depicts activation of A) CD4$^+$CD45RA$^-$ memory T cells and B) CD4$^+$CD45RA$^+$ naive T cells following incubation with [NC]PD-1-targeted IL-15/Rα-Fc fusions (and controls) as indicated by percentage cells expressing CD25.

FIG. 53 depicts percentage of A) CD4$^+$CD45RA$^-$ T cells and B) CD4$^+$CD45RA$^+$ T cells expressing PD-1 following incubation with [NC]PD-1-targeted IL-15/Rα-Fc fusions (and controls).

Figure 54:
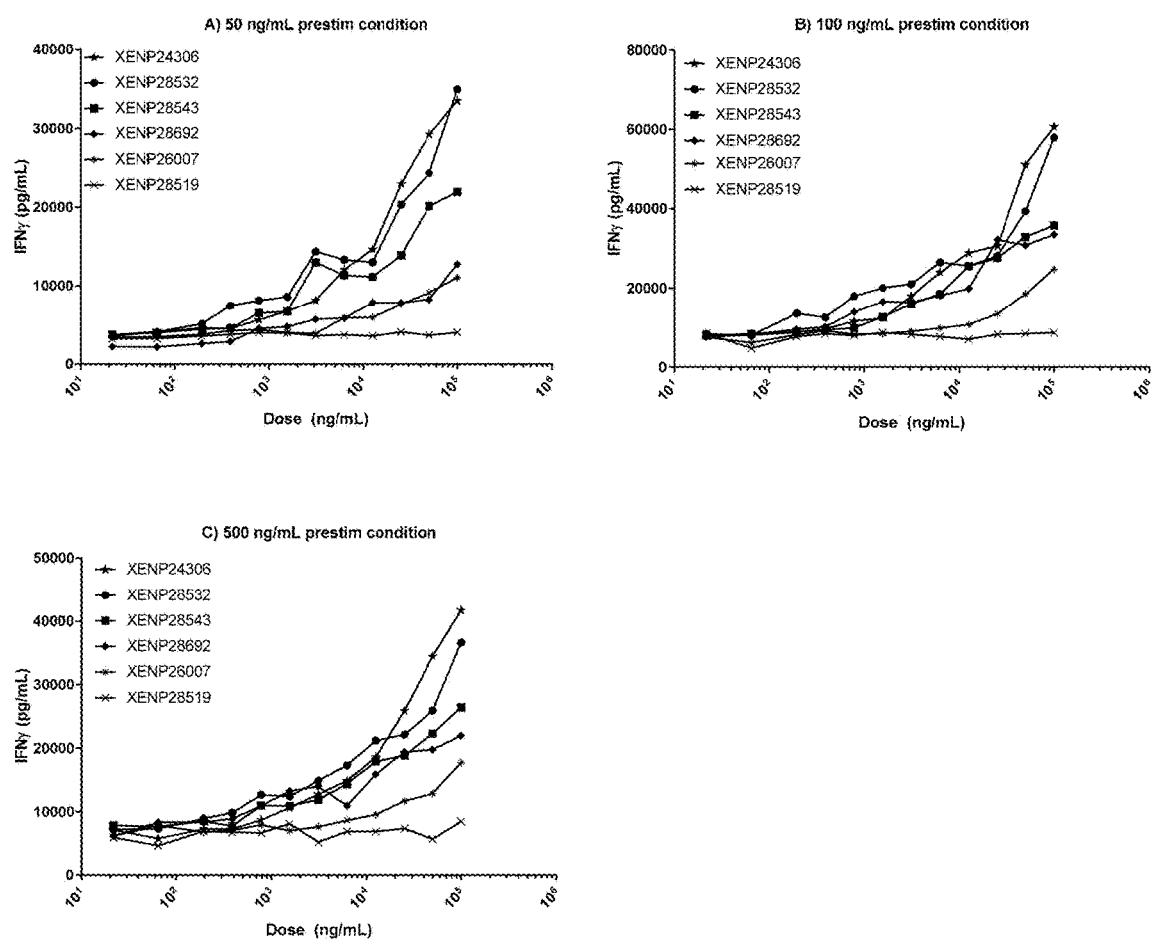

FIG. 54 depicts IFNγ secretion by PBMC prestimulated with A) 50 ng/ml, B) 100 ng/ml, and C) 500 ng/ml platebound anti-CD3 (OKT3) and incubated with the indicated test articles. The data show that both XENP28532 and XENP28543 were able to potently stimulate IFNγ secretion. Notably, XENP28532 (PD-1-targeting arm based on mAb A) appeared more active than XENP28543 (PD-1-targeting arm based on mAb C) in inducing IFNγ secretion.

Figure 55:
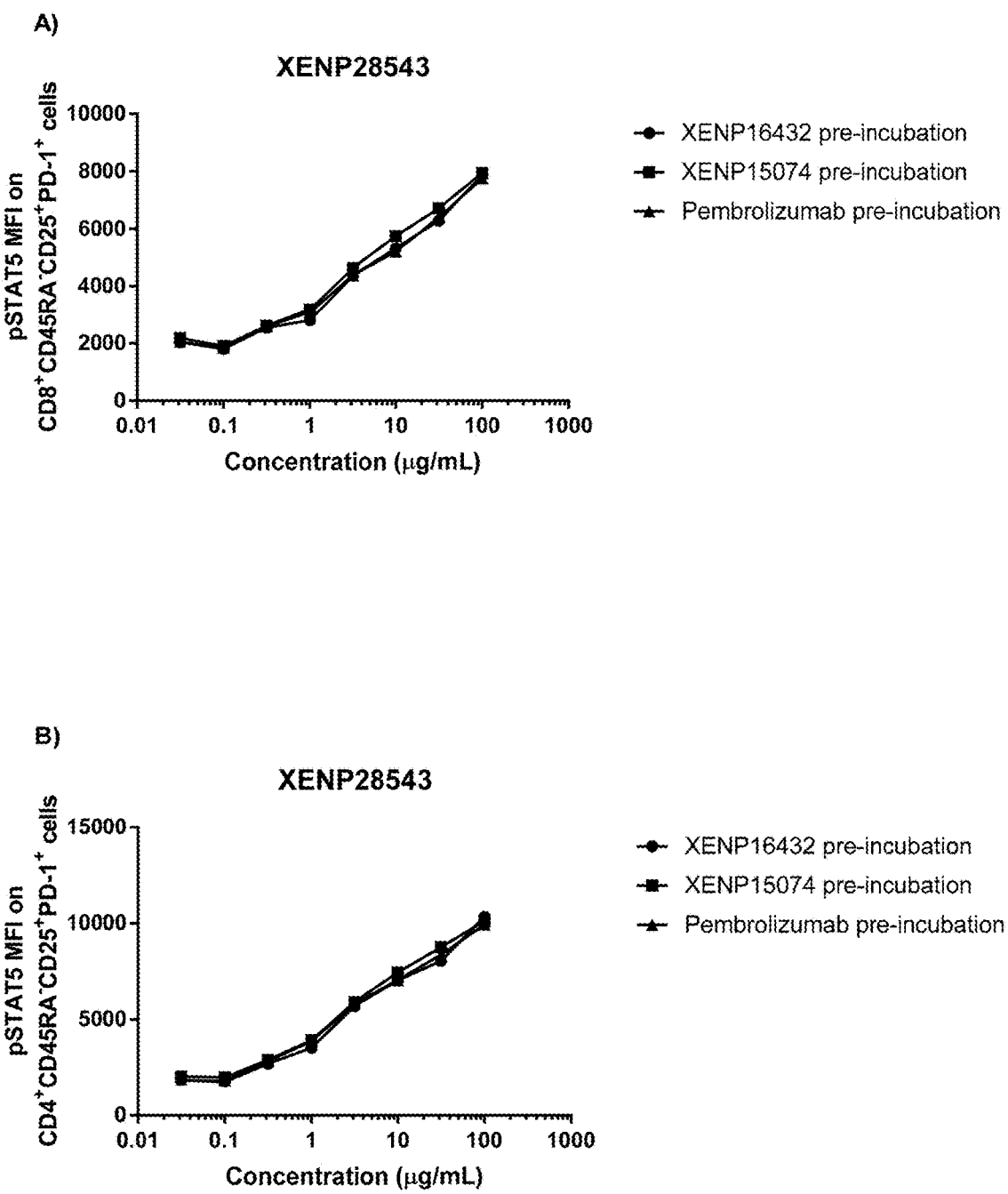

FIG. 55 depicts induction of STAT5 phosphorylation on A) CD8$^+$CD45RA$^-$ CD25$^{+PD}$-1$^+$ T cells and B) CD4$^+$ CD45RA$^-$CD25$^+$PD-1$^+$ T cells by XENP28543, [NC]PD-1-targeted IL-15/Rα-Fc fusion with PD-1-targeting arm based on mAb C, following pre-incubation with either nivolumab-based XENP16432, pembrolizumab, or anti-RSV mAb XENP15074. The data indicate that PD-1 blockade does not interfere with activity of XENP28543.

Figure 56:
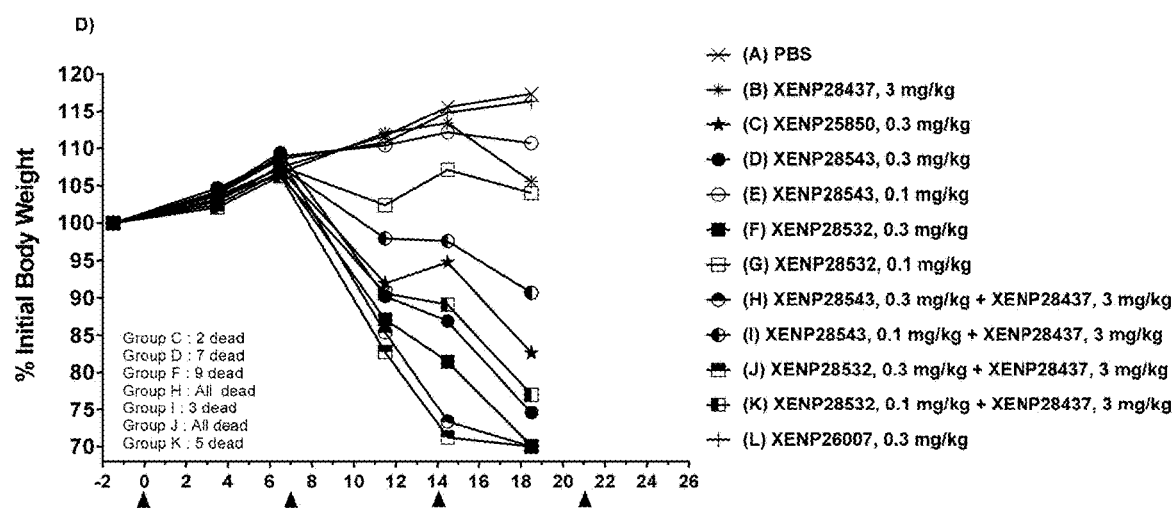

FIG. 56 depicts change in body weight in huPBMC-engrafted NSG mice over time (as a percentage of initial body weight) after dosing with the indicated test articles.

Figure 57:
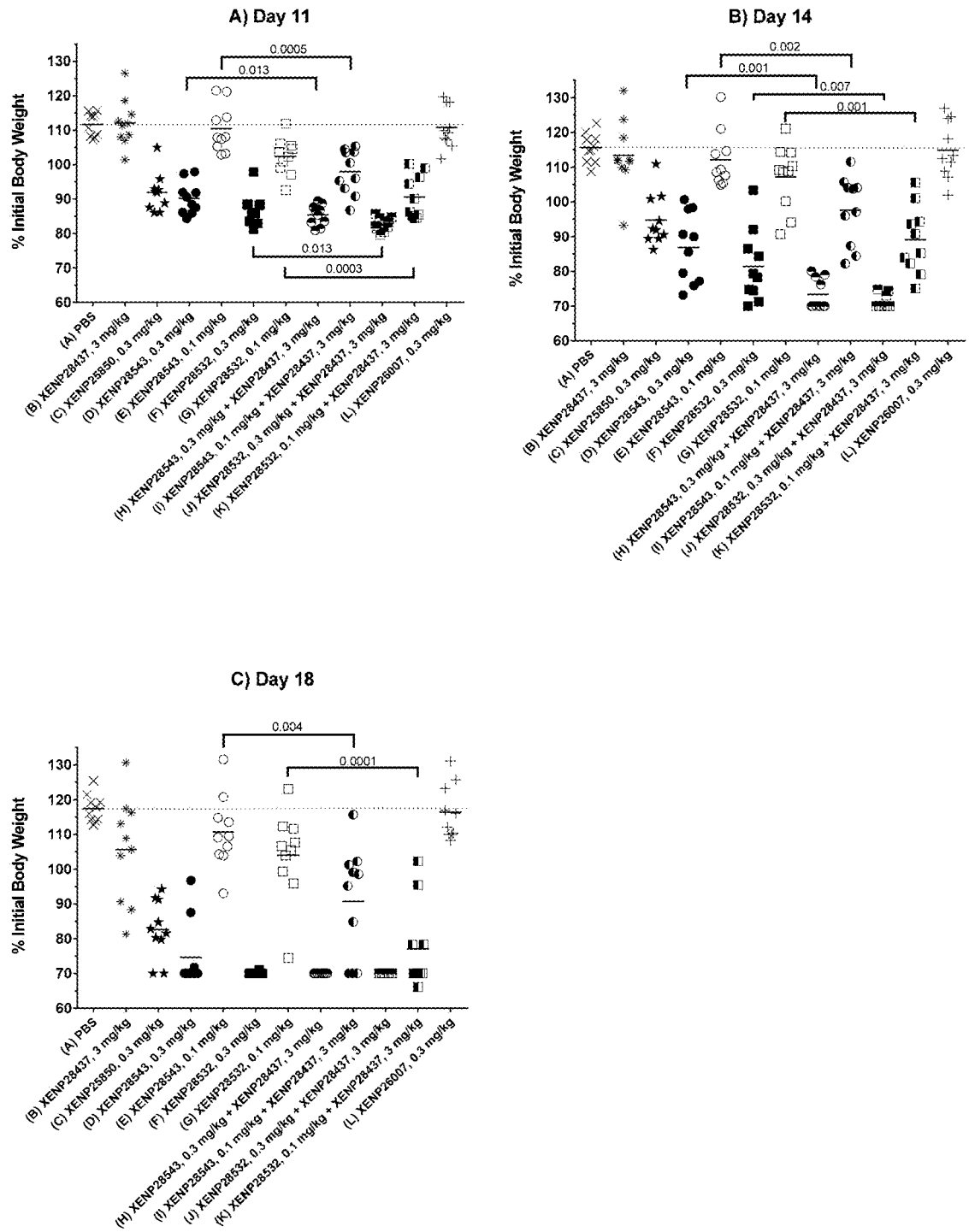

FIG. 57 depicts the body weight huPBMC-engrafted NSG mice (as a percentage of initial body weight) on Days A) 11, B) 14, and C) 18 after first dose with indicated test articles. p-values were determined using unpaired t-test. The data show that by Day 11, the combination of [NC]PD-1-targeted IL-15/Rα-Fc fusion with PD-1 blockade significantly enhanced GVHD over treatment with [NC]PD-1-targeted IL-15/Rα-Fc fusion alone.

Figure 58:
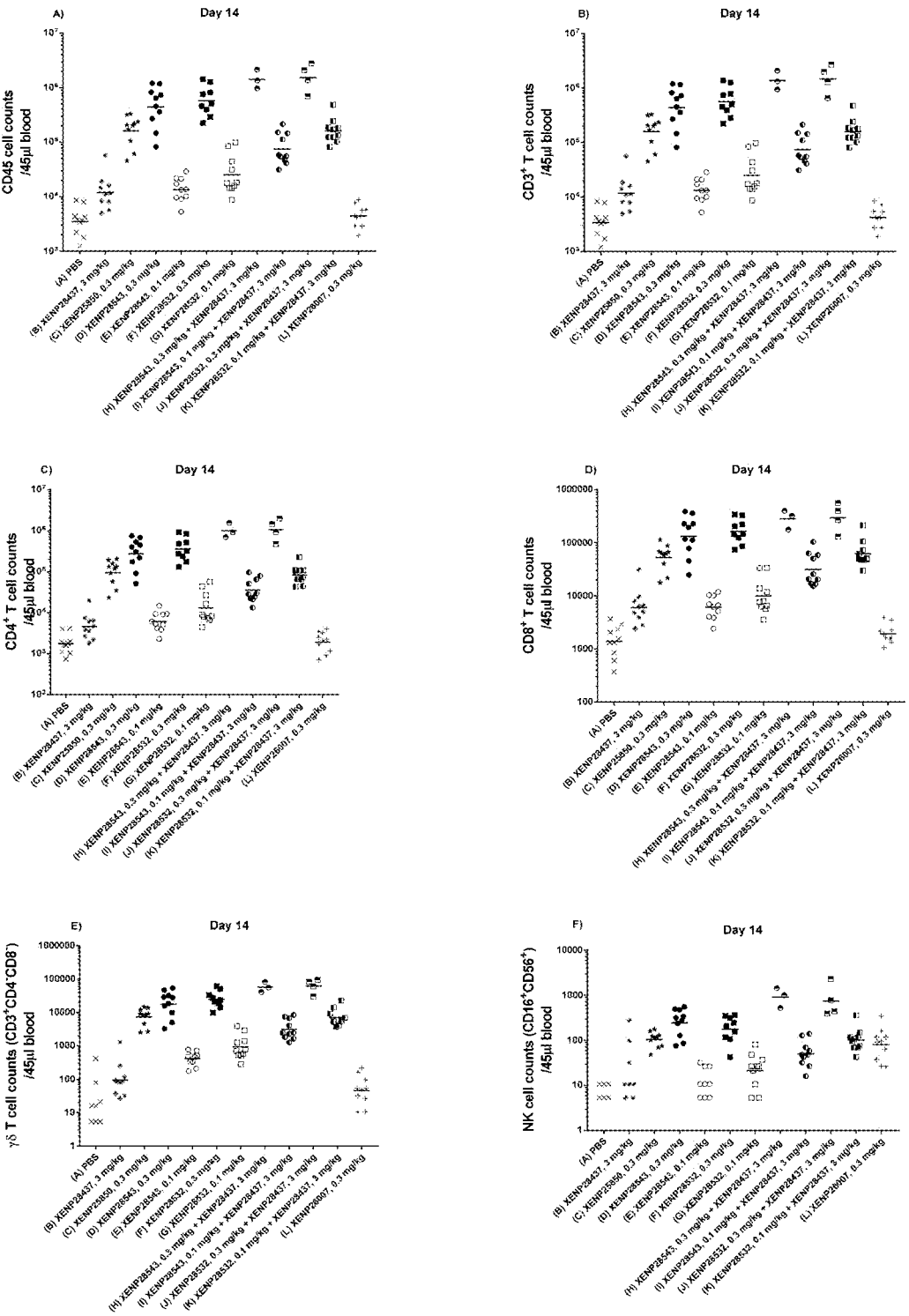

FIG. 58 depicts number of human A) CD45$^+$ cells, B) CD3$^+$ T cells, C) CD4$^+$ T cells, D) CD8$^+$ T cells, E) γδ T cells, and F) NK cells in blood of huPBMC-engrafted NSG mice on Day 14 after first dose with indicated test articles.

Figure 59:
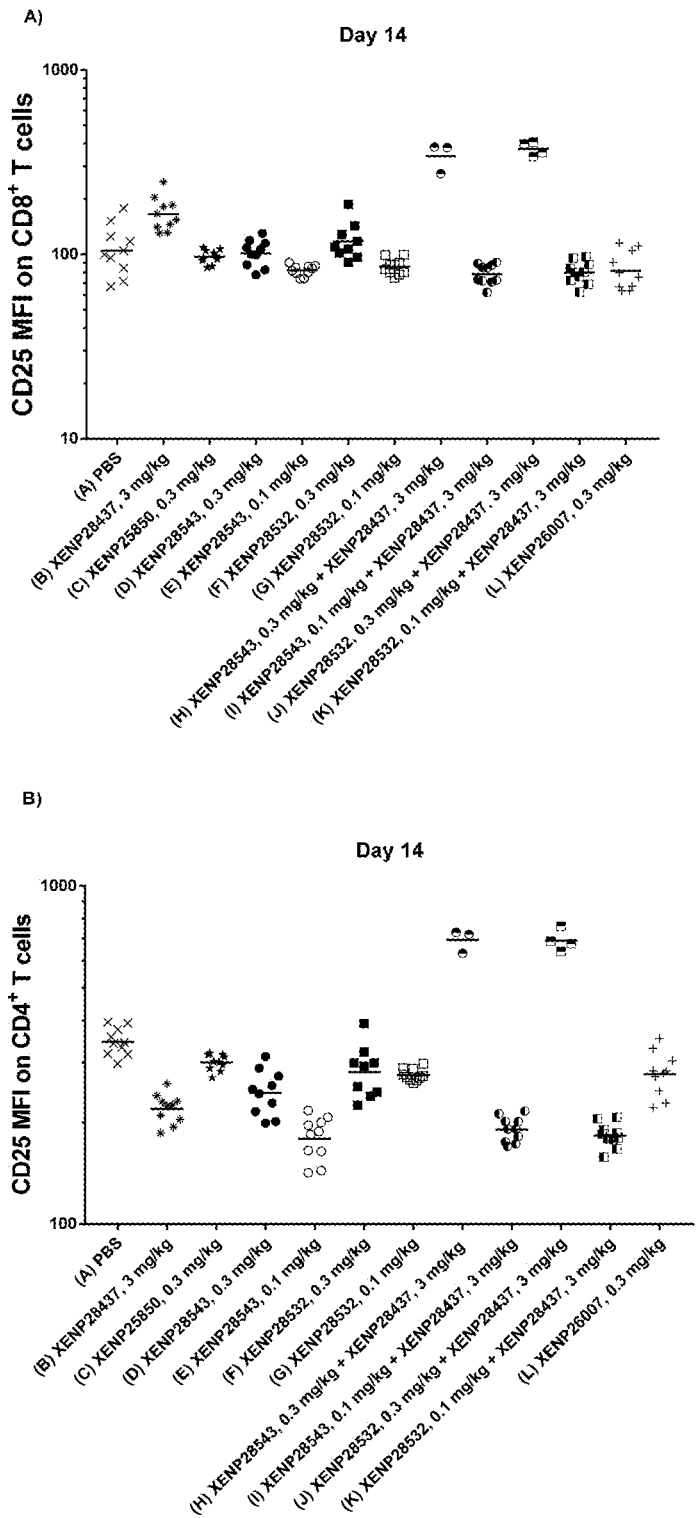

FIG. 59 depicts activation of human A) CD8$^+$ T cells and B) CD4$^+$ T cells (as indicated by CD25 MFI) in blood of huPBMC-engrafted NSG mice on Day 14 after first dose with indicated test articles.

Figure 60:
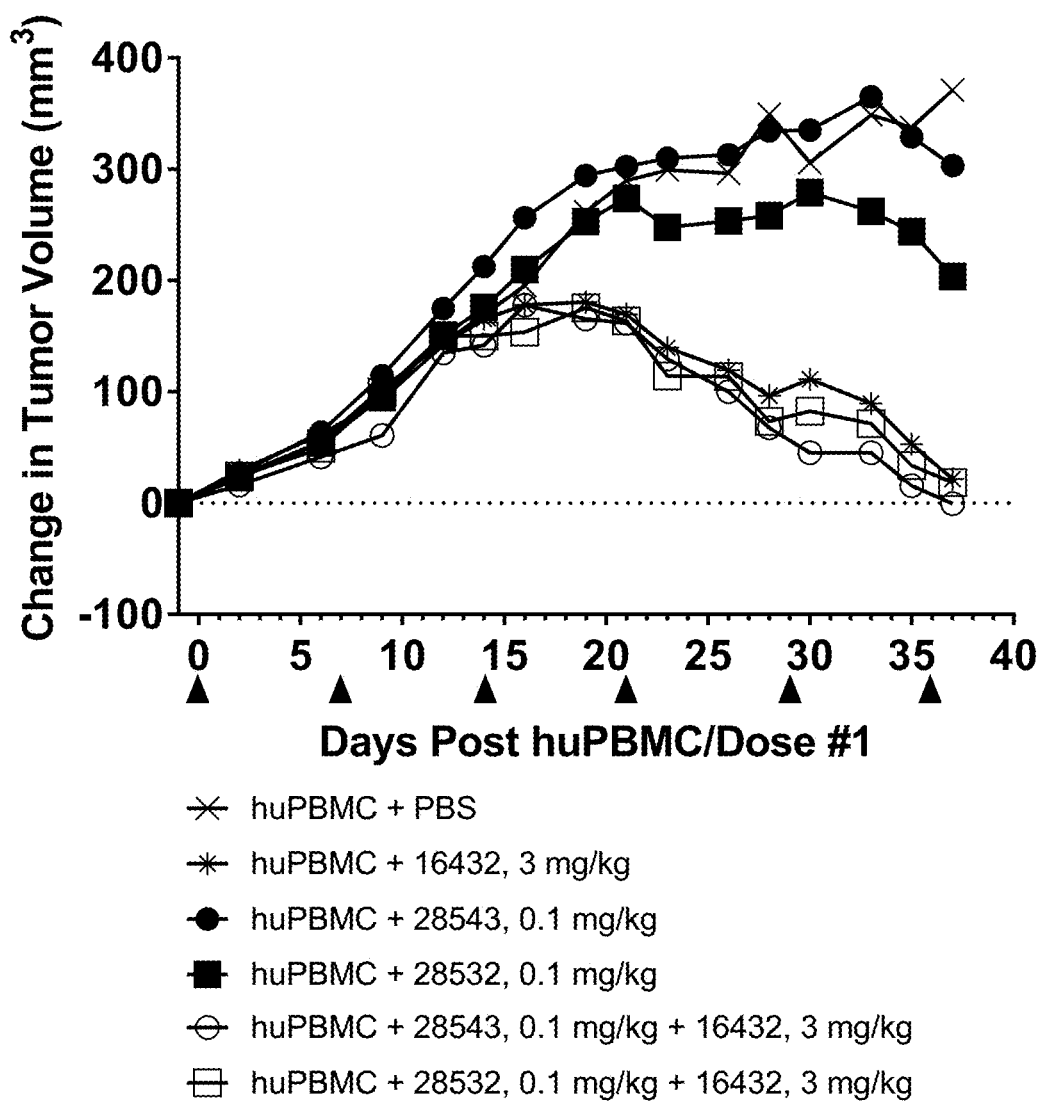

FIG. 60 depicts tumor volume (as determined by caliper measurements) over time in pp65-MCF7 and huPBMC-engrafted NSG mice dosed with [NC]PD-1-targeted IL-15/Rα-Fc fusions, alone or in combination with PD-1 blockade.

Figure 61:
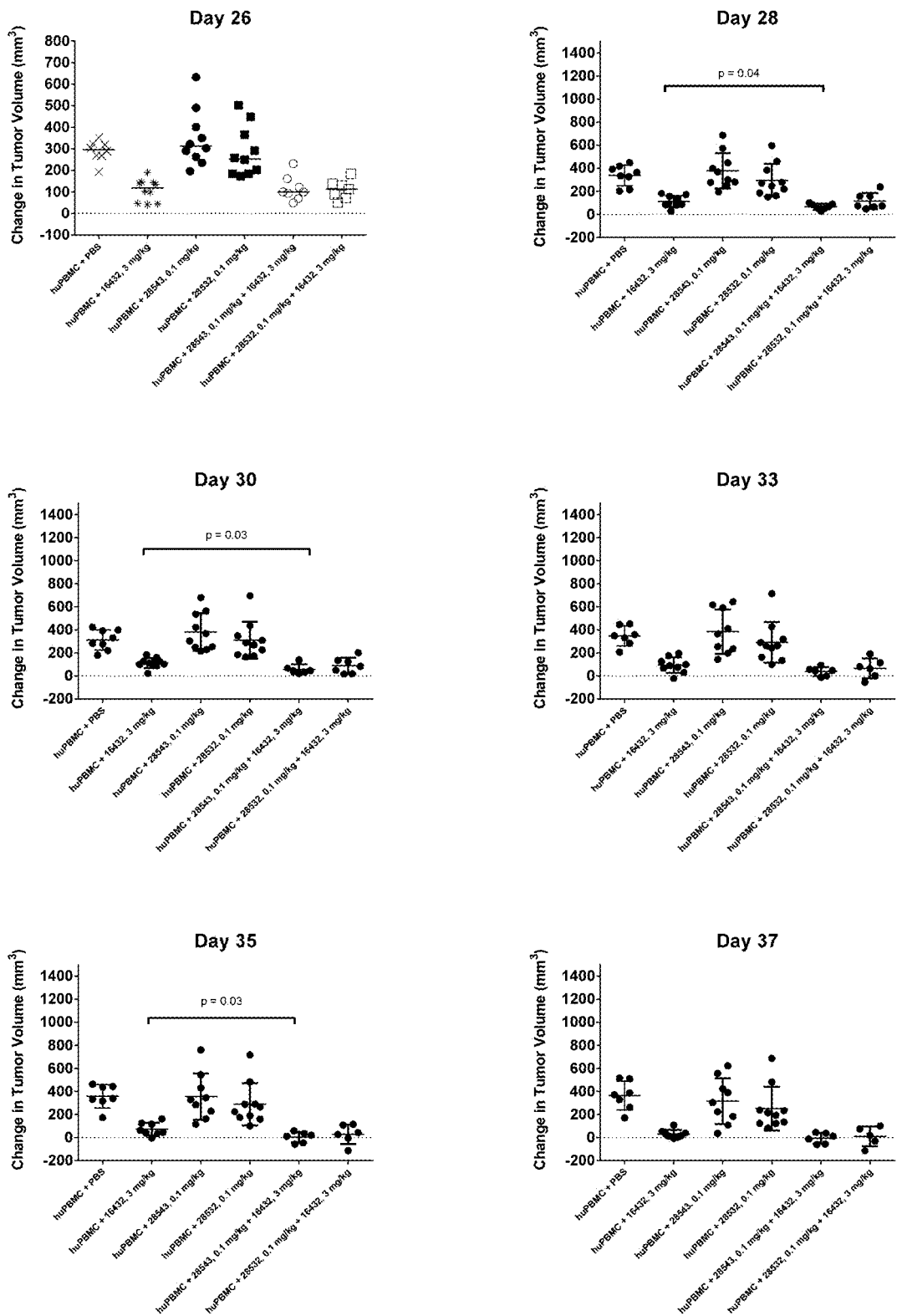

FIG. 61 depicts tumor volume (as determined by caliper measurements) on Days 26, 28, 30, 33, 35, and 37 (post PBMC engraftment and first dose of test articles) in pp65-MCF7 and huPBMC-engrafted NSG mice dosed with [NC] PD-1-targeted IL-15/Rα-Fc fusions, alone or in combination with PD-1 blockade. p-values were determined by unpaired t-test. The data show that by Day 28, the combination of XENP28543 with PD-1 blockade effected significantly reduced tumor size over treatment with PD-1 blockade alone alone.

FIG. 62 depicts activation of human A) CD8$^+$ T cells and B) CD4$^+$ T cells (as indicated by CD25 MFI) in blood of pp65-MCF7 and huPBMC-engrafted NSG mice on Day 7 after first dose with indicated test articles. The data show that the [NC]PD-1-targeted IL-15/Rα-Fc fusions, alone or in combination with PD-1 blockade, enabled significantly enhanced early activation of CD8$^+$ T cells. Statistics were performed on log-transformed data using unpaired t-test.

Figure 63:
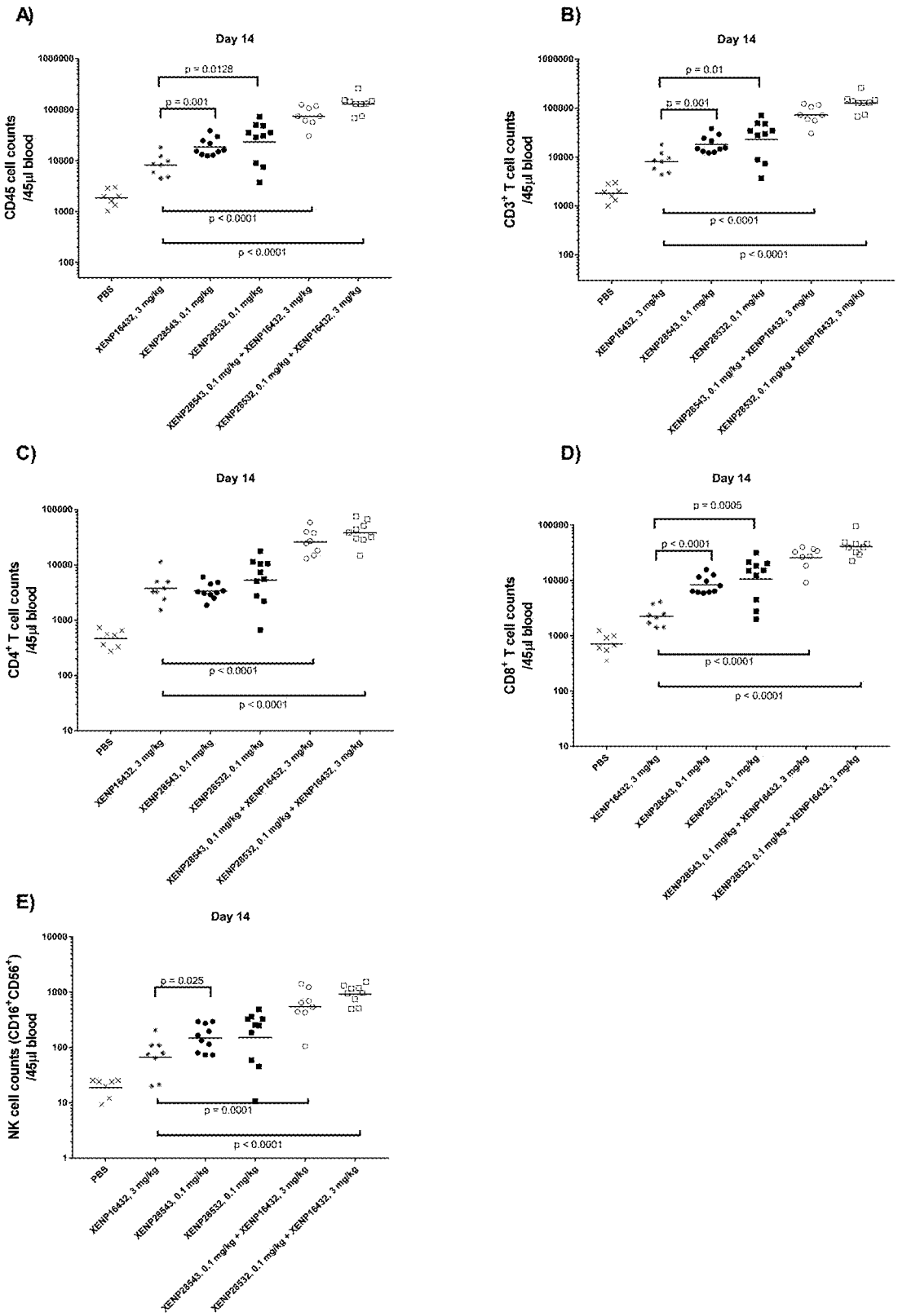

FIG. 63 depicts number of human A) CD45$^+$ cells, B) CD3$^+$ T cells, C) CD4$^+$ T cells, D) CD8$^+$ T cells, and E) NK cells in blood of pp65-MCF7 and huPBMC-engrafted NSG mice on Day 14 after first dose with indicated test articles. The data show that the [NC]PD-1-targeted IL-15/Rα-Fc fusions, alone or in combination with PD-1 blockade, enabled significantly enhanced expansion of numerous lymphocyte populations by Day 14 over PD-1 blockade alone. Statistics were performed on log-transformed data using unpaired t-test.

FIG. 64 depicts the sequences for illustrative affinity-engineered variants of anti-PD-1 mAb C in bivalent human IgG1 format with E233P/L234V/L235A/G236del/S267K substitutions in the heavy chain. The CDRs are underlined, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-15/Rα-Fc fusion proteins of the invention.

FIG. 65A-65I depicts apparent dissociation constant ($K_{Dapp}$), association rate ($k_a$), and dissociation rate (10 of affinity-engineered mAb C[PD-1]_H1_L1 variants (in bivalent IgG1 format with E233P/L234V/L235A/G236_/S267K ablation variants) as determined by Octet, as well as fold improvement over mAb C[PD-1]_H1_L1. Substitutions in variable heavy or variable light regions, where listed, are based on Xencor numbering (with corresponding Kabat position listed in the next column). Out of 304 variants having single point mutation in either the variable heavy or the variable light region, we only identified 11 variants (including mAb C[PD-1]_H1_L1.1 and mab_C[PD-1]_H1_L1.3) having greater than 2-fold improved affinity over WT. It should be noted that for the Kabat number column, some positions are numbered using letters as well; for example, in Kabat numbering, there is one amino acid at position 27d (N27d) but a different amino acid at position 27e (S27e); that is, the inclusion of the small letters denotes a position, not a particular amino acid in that position.

FIG. 66 depicts apparent dissociation constant ($K_{Dapp}$), association rate ($k_a$), and dissociation rate (10 of affinity-engineered mAb C[PD-1]_H1_L1 variants combining favorable single substitution VH variant and single substitution VL variant (in the context of PD-1-targeted IL15/Rα-Fc) as determined by Octet. Substitutions in variable heavy or variable light regions, where listed, are based on Xencor numbering (with corresponding Kabat position listed in the next column). H1.19_L1.1 enables higher affinity than H1.132_L1.1, despite H1.132_L1 providing higher affinity than H1.19_L1.

FIG. 67 depicts apparent dissociation constant ($K_{Dapp}$), association rate ($k_a$), and dissociation rate ($k_d$) of affinity-engineered mAb C[PD-1]_H1_L1 variants combining multiple substitutions in the VH and/or VL (in the context of PD-1-targeted IL15/Rα-Fc) as determined by Octet. Substitutions in variable heavy or variable light regions, where listed, are based on Xencor numbering (with corresponding Kabat position listed in the next column). Triple substitution VL variant N31H/K36Y/S99T (L1.140; N27dH/K30Y/S93T in Kabat numbering) demonstrates 36-fold improvement in $K_D$ over wild-type, and combines well with VH variants to exert ~100 fold improvement in $K_D$ over wild-type.

FIG. 68A-68H depicts sequences of illustrative [NC]PD-1-targeted IL-15/Rα-Fc fusion proteins of the "scIL-15/Rα×Fab" format comprising PD-1 targeting arm based on affinity optimized mAb C ABD and various IL-15 potency variants. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. Linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, variable regions, and constant/Fc regions. As will be clear to those skilled in the art, each of the PD-1-targeted IL-15/Rα-Fc fusion proteins described can also exclude or include Xtend Fc (M428L/N434S).

FIG. 69A-69B depicts sequences of illustrative [NC]PD-1-targeted IL-15/Rα-Fc fusion proteins of the "scIL-15/Rα×Fab" format comprising PD-1 targeting arm based on based on affinity optimized mAb C ABD and various IL-15 potency variants, additionally comprising Xtend Fc (M428L/N434S). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. Linkers are double underlined (although as will be appreciated by those in the art, the linkers can be replaced by other linkers, some of which are depicted in FIGS. 8 and 9), and slashes (/) indicate the border(s) between IL-15, IL-15Rα, linkers, variable regions, and constant/Fc regions.

Figure 70:
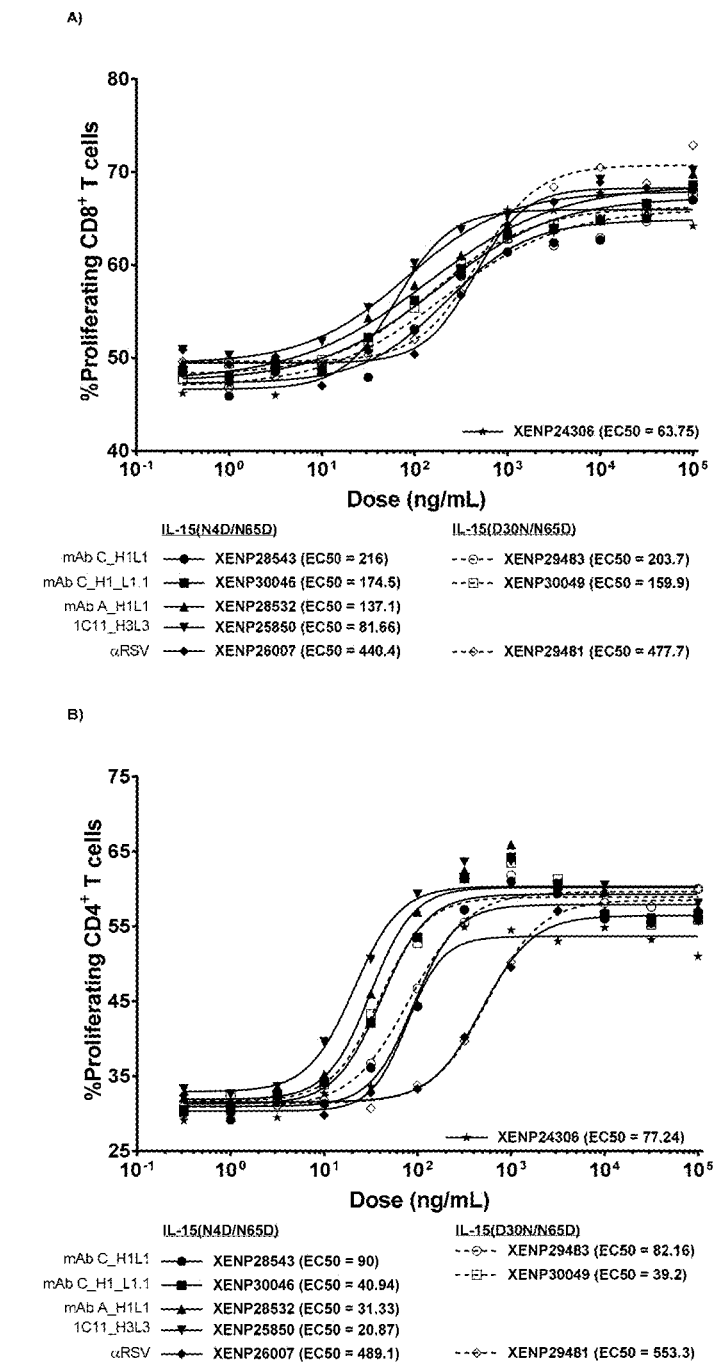

FIG. 70 depicts induction of A) CD8+ T cells and B) CD4+ T cells proliferation by [NC]PD-1-targeted IL-15/Rα-Fc fusions having varying PD-1 affinity and IL-15 potency variants (and controls) as indicated by percentage proliferating cells (determined based on CFSE dilution). The data show that XENP30046 (having an affinity-enhanced PD-1-targeting arm) induces proliferation of both CD8+ and CD4+ T cells more potently than does XENP28543 (2-fold increase). Additionally, the data show that the IL-15(D30N/N65D) variant does not drastically affect the activity of the PD-1-targeted IL-15/Rα-Fc fusions.

Figure 71:
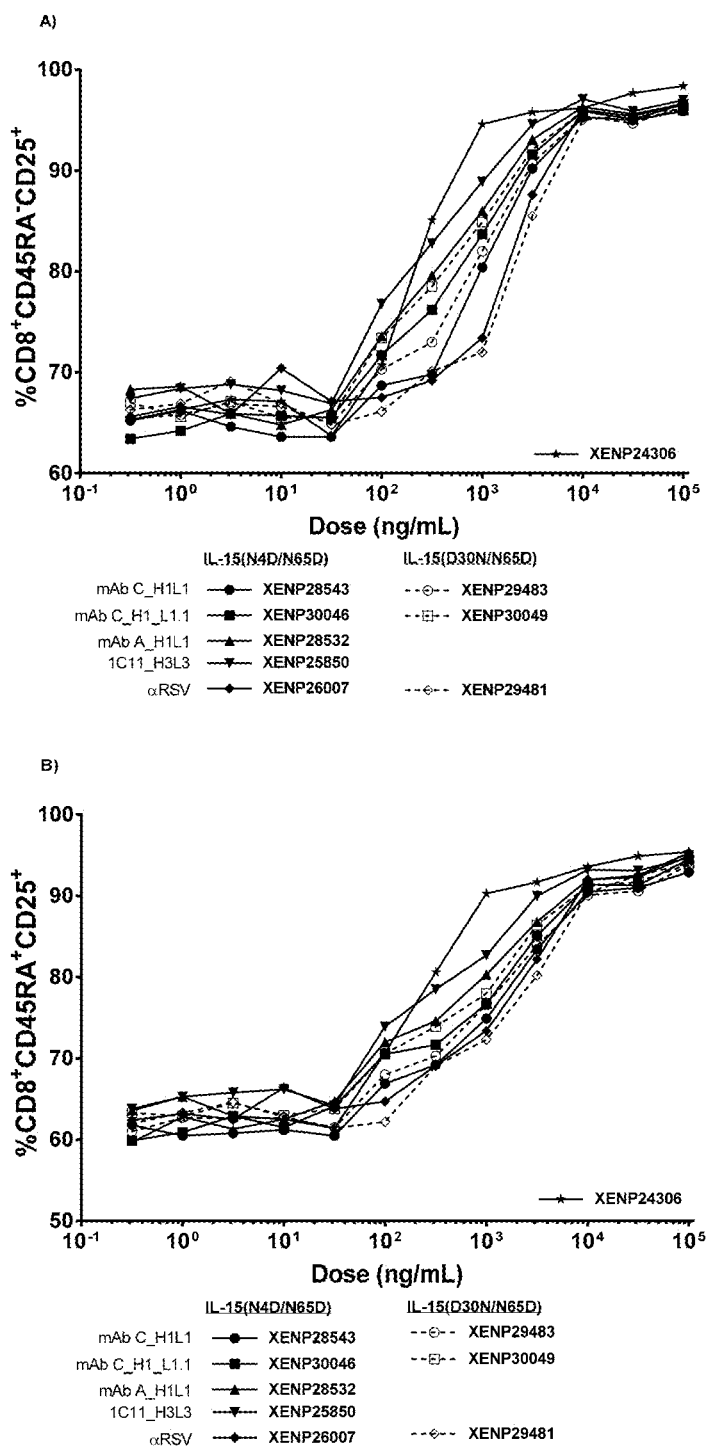

FIG. 71 depicts activation of A) CD8+CD45RA− T cells and B) CD8+CD45RA+ T cells following incubation with [NC]PD-1-targeted IL-15/Rα-Fc fusions with varying PD-1 affinity and IL-15 potency variants (and controls) as indicated by percentage cells expressing CD25.

Figure 72:
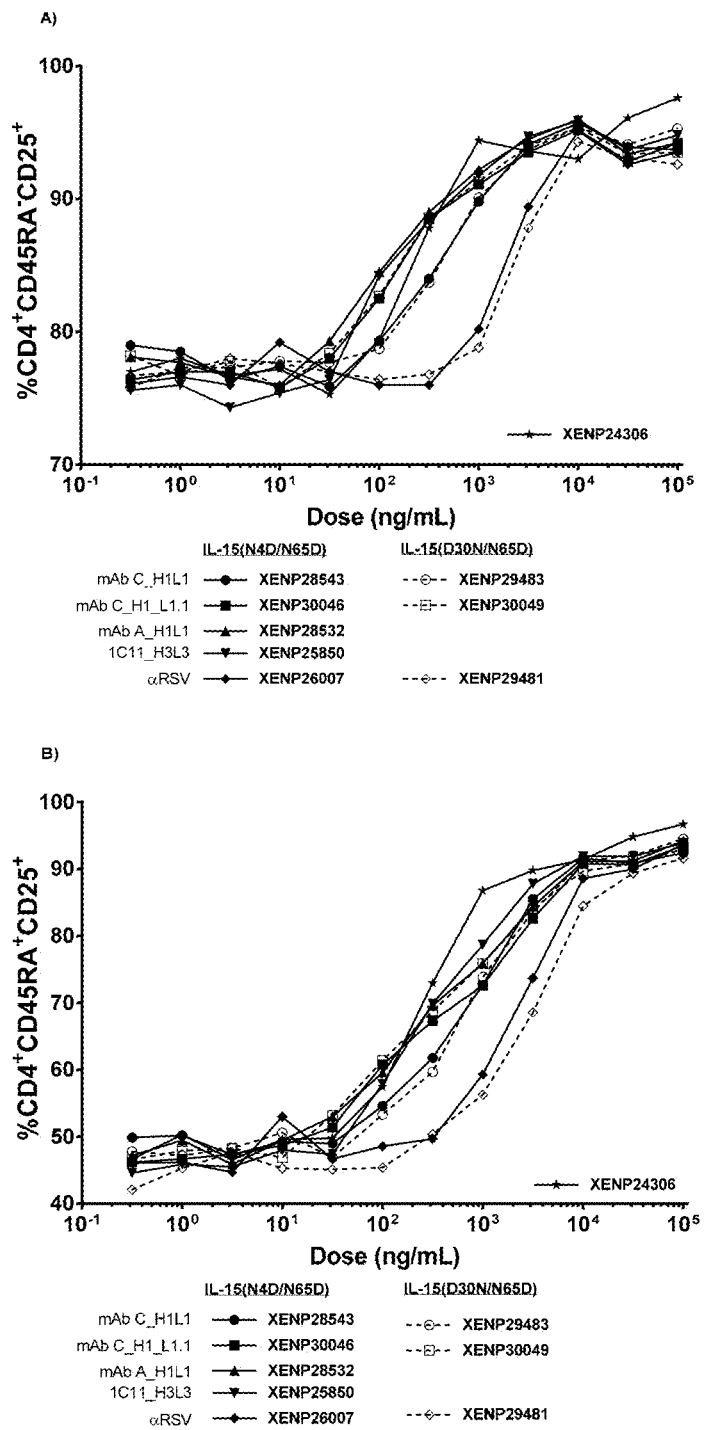

FIG. 72 depicts activation of A) CD4+CD45RA− T cells and B) CD4+CD45RA+ T cells following incubation with [NC]PD-1-targeted IL-15/Rα-Fc fusions with varying PD-1 affinity and IL-15 potency variants (and controls) as indicated by percentage cells expressing CD25.

Figure 73:
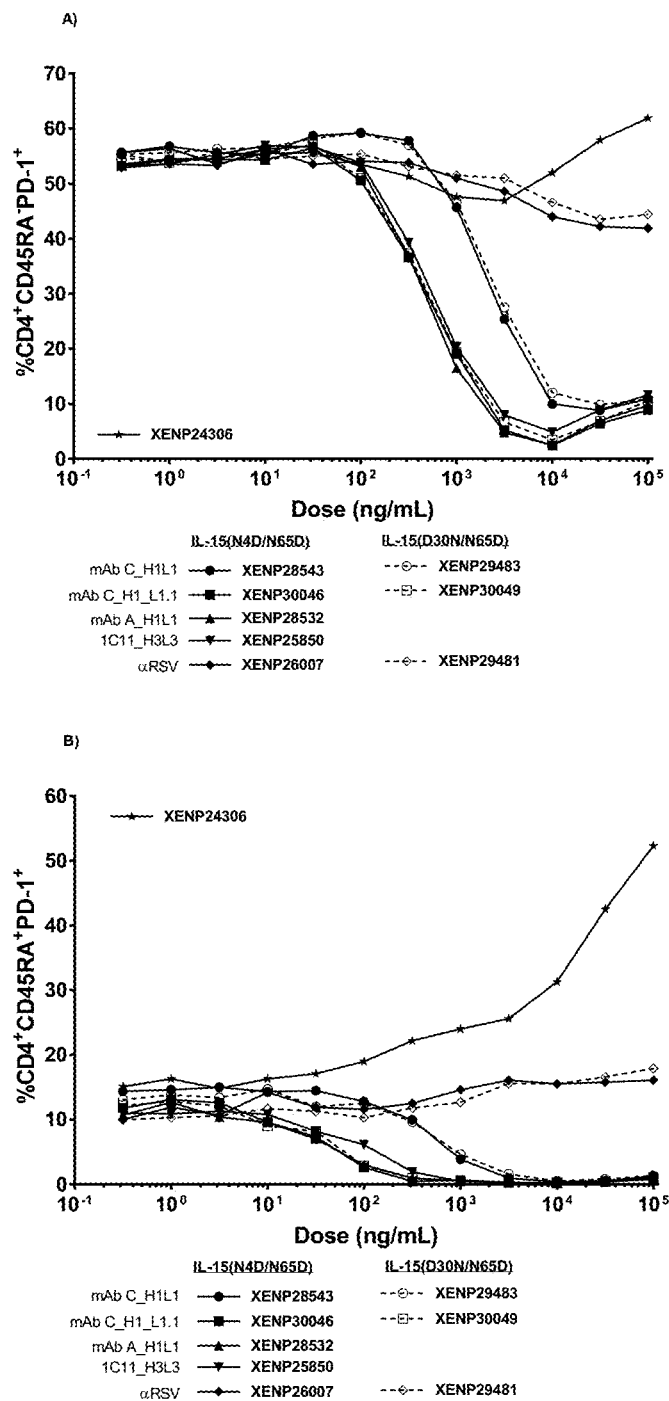

FIG. 73 depicts percentage of A) CD4+CD45RA− T cells and B) CD4+CD45RA+ T cells expressing PD-1 following incubation with [NC]PD-1-targeted IL-15/Rα-Fc fusions with varying PD-1 affinity and m-15 potency variants (and controls). The data show that [NC]PD-1-targeted IL-15/Rα-Fc fusions induce downregulation of PD-1 in CD4+ cells, and that downregulation correlates with PD-1 affinity.

Figure 74:
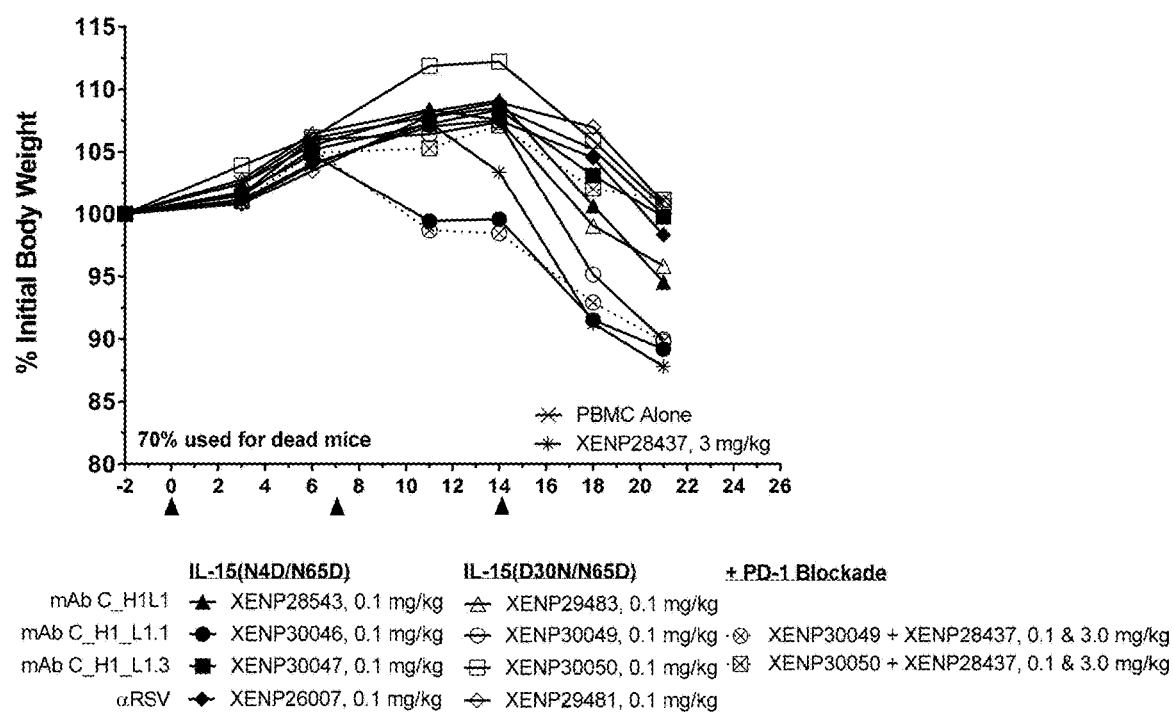

FIG. 74 depicts the change in body weight (as a percentage of initial body weight) over time in huPBMC-engrafted NSG mice treated with [NC]PD-1-targeted IL-15/Rα-Fc fusions with varying PD-1 affinity and IL-15 potency variants (and controls). 70% was used for dead mice.

Figure 75:
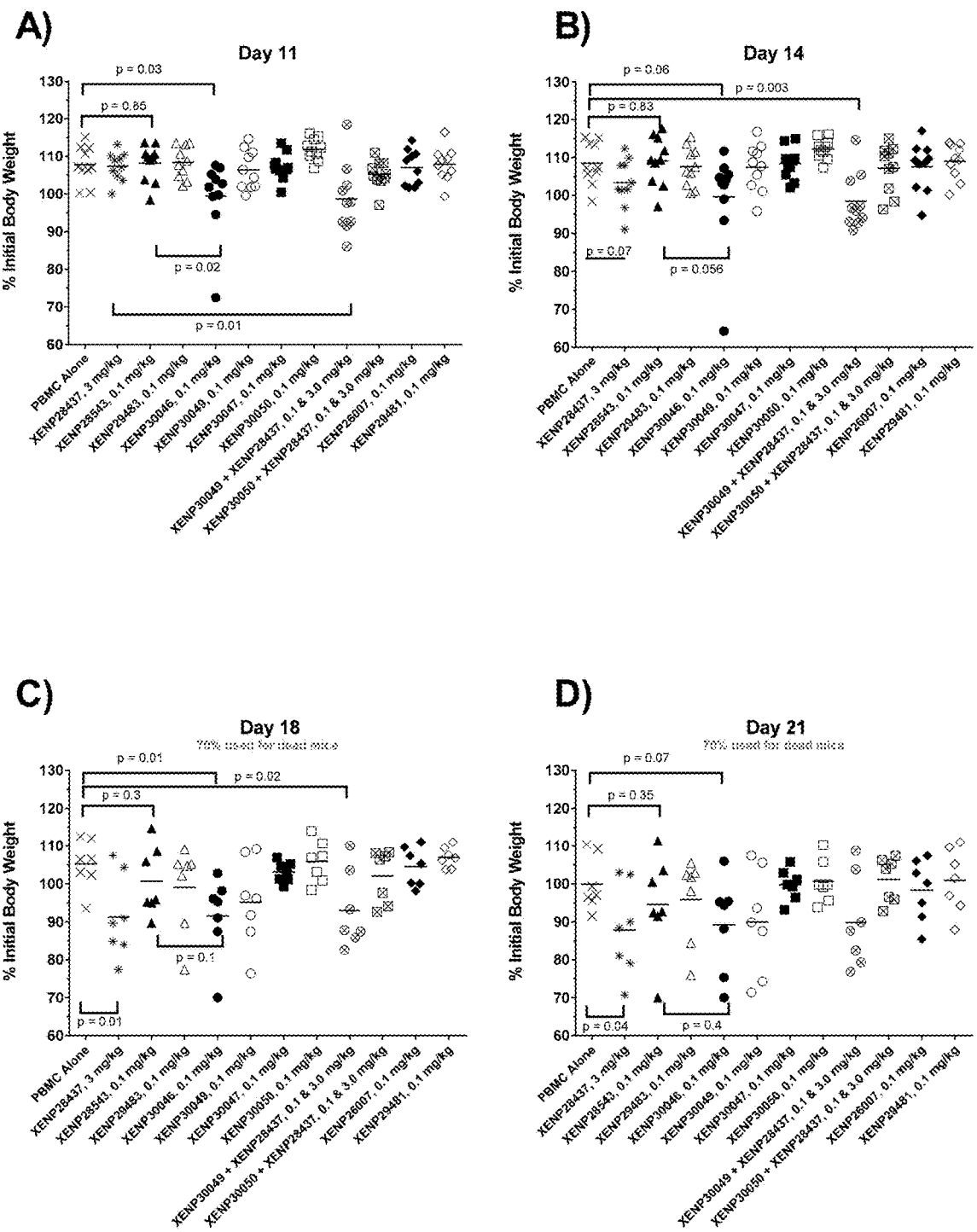

FIG. 75 depicts body weight on Days A) 11, B) 14, C) 18, and D) 21 of huPBMC-engrafted NSG mice treated with [NC]PD-1-targeted IL-15/Rα-Fc fusions with varying PD-1 affinity and IL-15 potency variants (and controls). 70% was used for dead mice. p-value were determined using unpaired t-test. The data show that treatment with XENP30046 alone (having affinity-enhanced PD-1-targeting arm) resulted in significant body weight loss as measured on Days 11 and 18 in comparison to PBS treatment, whereas, treatment with XENP28543 alone did not yield significant weight loss (in comparison to PBS treatment).

Figure 76A:
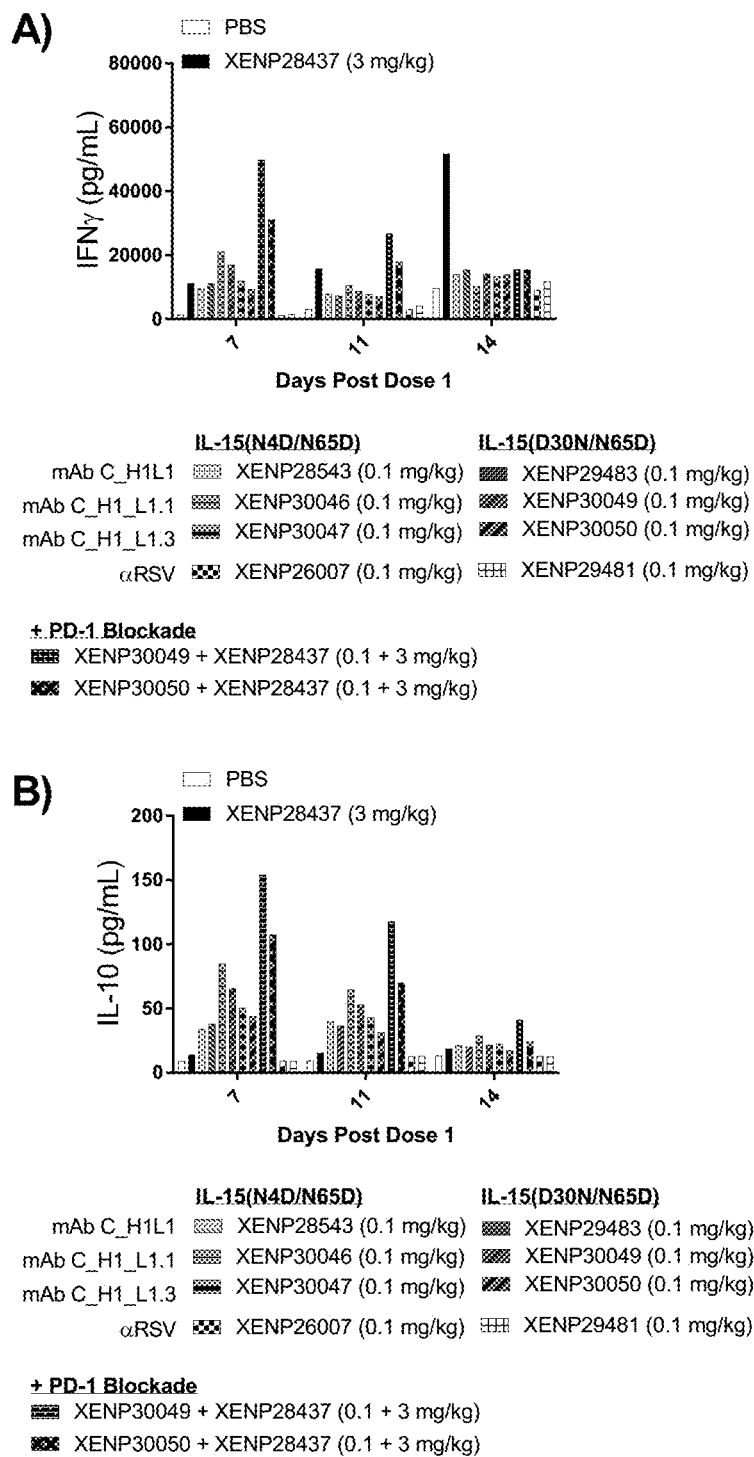
Figure 76C:
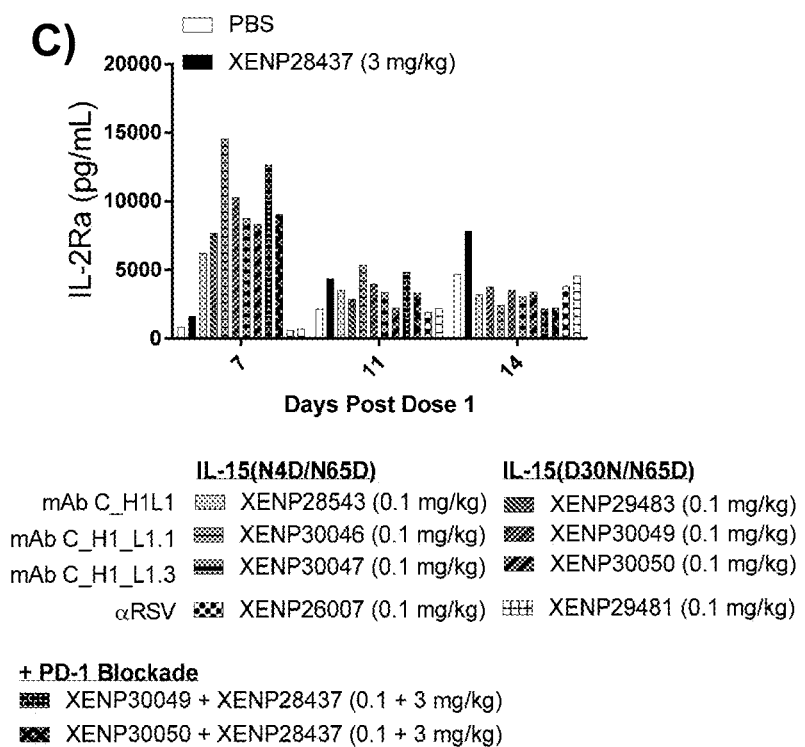

FIG. 76A-76C depicts serum concentration of A) IFNγ, B) IL-10, and C) IL-2Rα in huPBMC-engrafted NSG mice on Days 7, 11, and 14 after dosing with [NC]PD-1-targeted IL-15/Rα-Fc fusions with varying PD-1 affinity and IL-15 potency variants (and controls).

FIG. 77 depicts activation of A) CD4+ T cells and B) CD8+ T cells (as indicated by CD25 MFI) on Day 7 in blood of huPBMC-engrafted NSG mice dosed with [NC]PD-1-targeted IL-15/Rα-Fc fusions with varying PD-1 affinity and IL-15 potency variants (and controls) (statistics were performed on log-transformed data using unpaired t-test).

Figure 78:
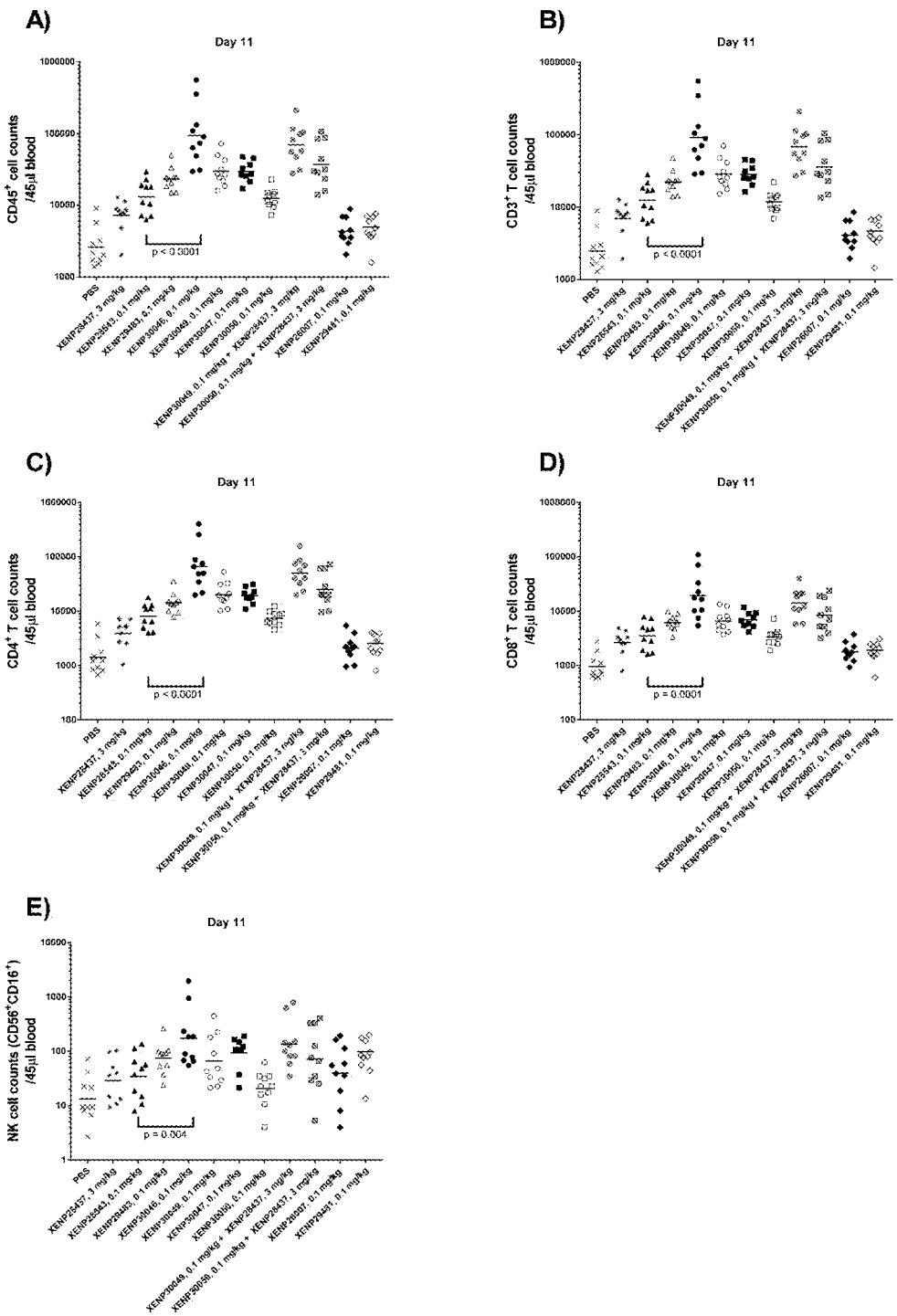

FIG. 78 depicts A) CD45+ cell, B) CD3+ T cell, C) CD8+ T cell, D) CD4+ T cell, and E) NK cell counts on Day 11 in blood of huPBMC-engrafted NSG mice dosed with [NC] PD-1-targeted IL-15/Rα-Fc fusions with varying PD-1 affinity and IL-15 potency variants (and controls) (statistics were performed on log-transformed data using unpaired t-test).

Figure 79:
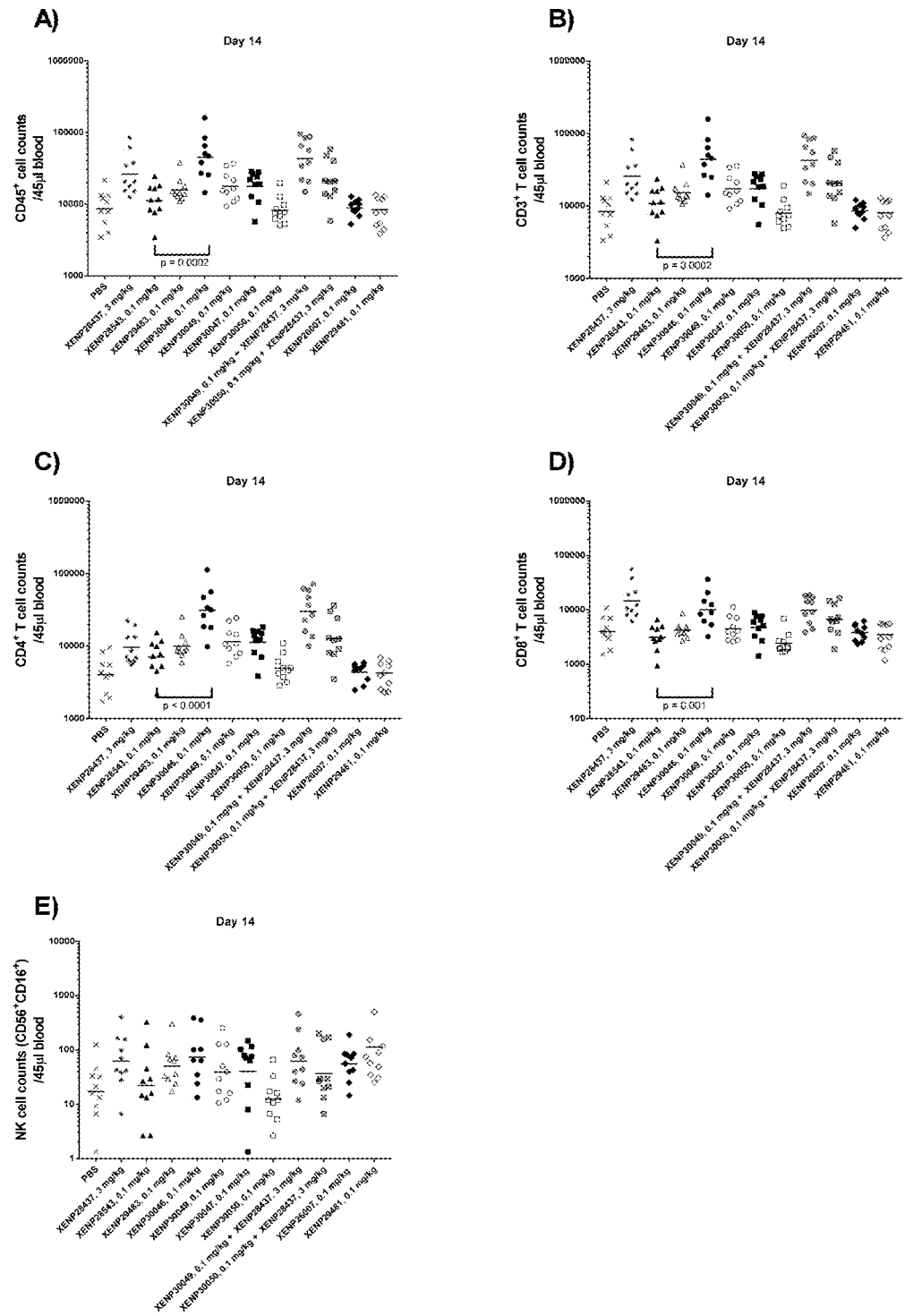

FIG. 79 depicts A) CD45+ cell, B) CD3+ T cell, C) CD8+ T cell, D) CD4+ T cell, and E) NK cell counts on Day 14 in blood of huPBMC-engrafted NSG mice dosed with [NC] PD-1-targeted IL-15/Rα-Fc fusions with varying PD-1 affinity and IL-15 potency variants (and controls).

Figure 80:
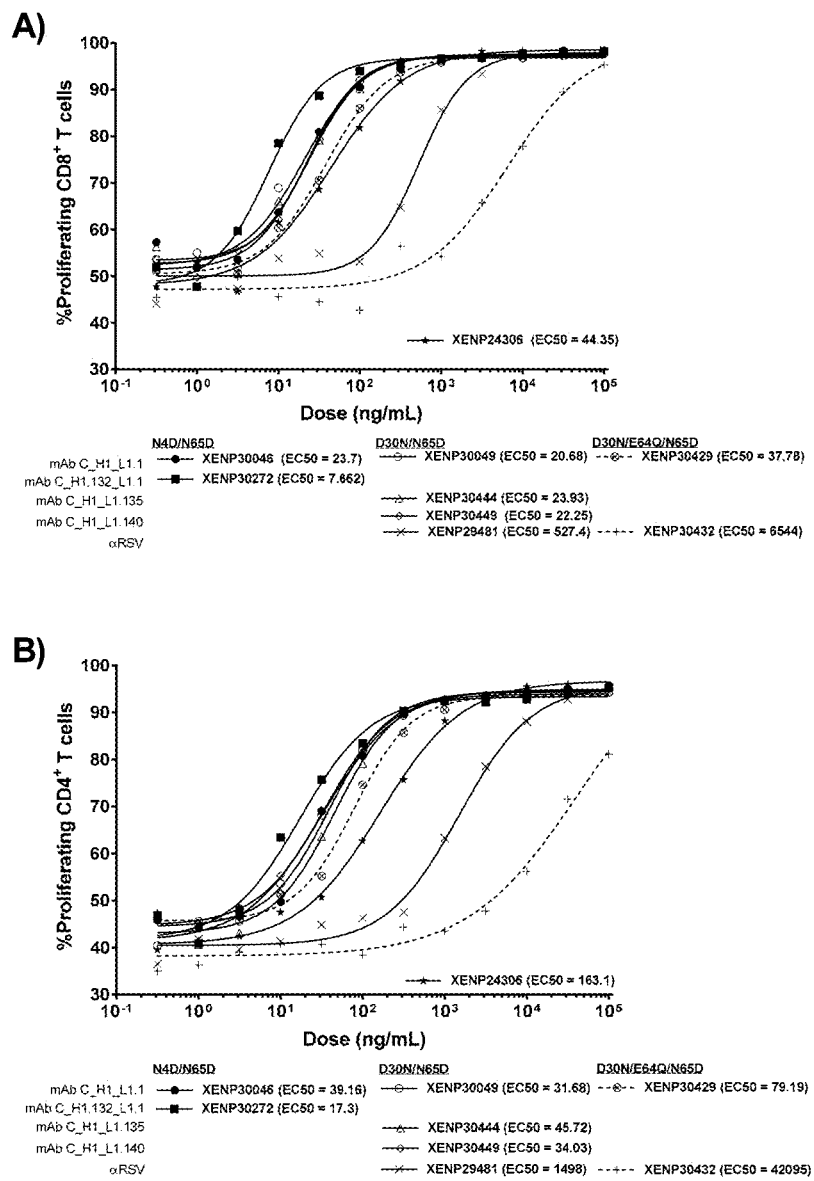

FIG. 80 depicts induction of A) CD8+ T cells and B) CD4+ T cells proliferation by [NC]PD-1-targeted IL-15/Rα-Fc fusions having varying PD-1 affinity and IL-15 potency variants (and controls) as indicated by percentage proliferating cells (determined based on CFSE dilution). The data show that XENP30272 (which has a $K_D$ of 3.1 nM for PD-1) is more potent at inducing proliferation and activation of various T cell populations than XENP30046 (which has a $K_D$ of 5.4 nM for PD-1). Notably, while XENP30429 (PD-1-targeted IL-15/Rα-Fc fusions having IL-15(D30N/ E64Q/N65D) variant) was only 1.8 to 2.5 less active on CD8+ and CD4+ T cells in comparison to XENP30046 (PD-1-targeted IL-15/Rα-Fc fusions having IL-15(N4D/ N65D) variant), XENP30432 (surrogate RSV-targeted IL-15/Rα-Fc having IL-15(D30N/E64Q/N65D) variant) was 12 fold less active on CD8+ T cells and 530 fold less active on CD4+ T cells in comparison to XENP30046 (based on proliferative activity). This suggests that PD-1-targeted IL-15/Rα-Fc fusions having IL-15(D30N/E64Q/N65D) variant should retain activity in the tumor environment, while remaining substantially inactive outside of the tumor environment.

Figure 81:
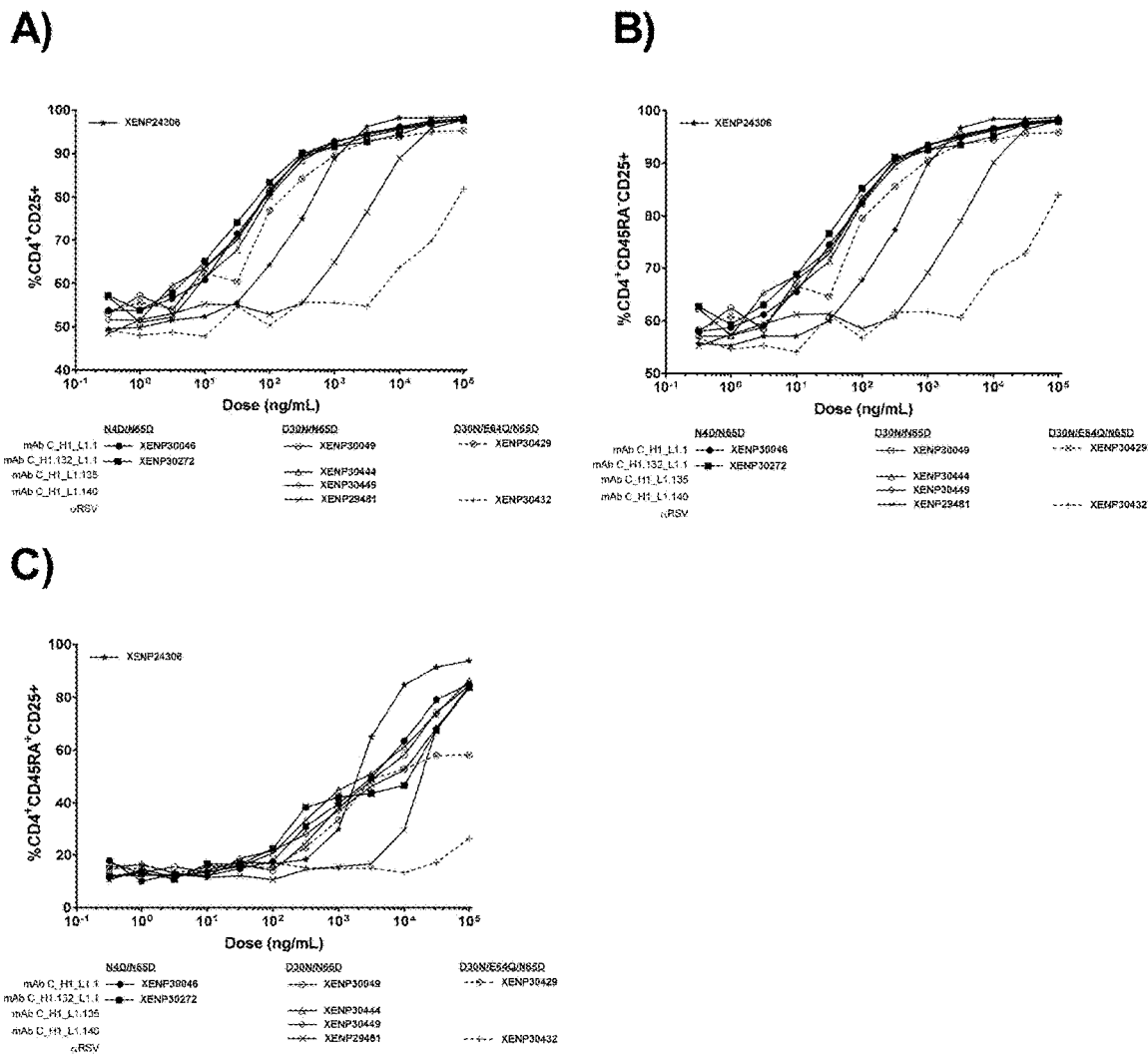

FIG. 81 depicts activation of A) CD4+ T cells, B) CD4+ CD45RA− T cells and C) CD4+CD45RA+ T cells following incubation with [NC]PD-1-targeted IL-15/Rα-Fc fusions with varying PD-1 affinity and IL-15 potency variants (and controls) as indicated by CD25 MFI.

Figure 82:
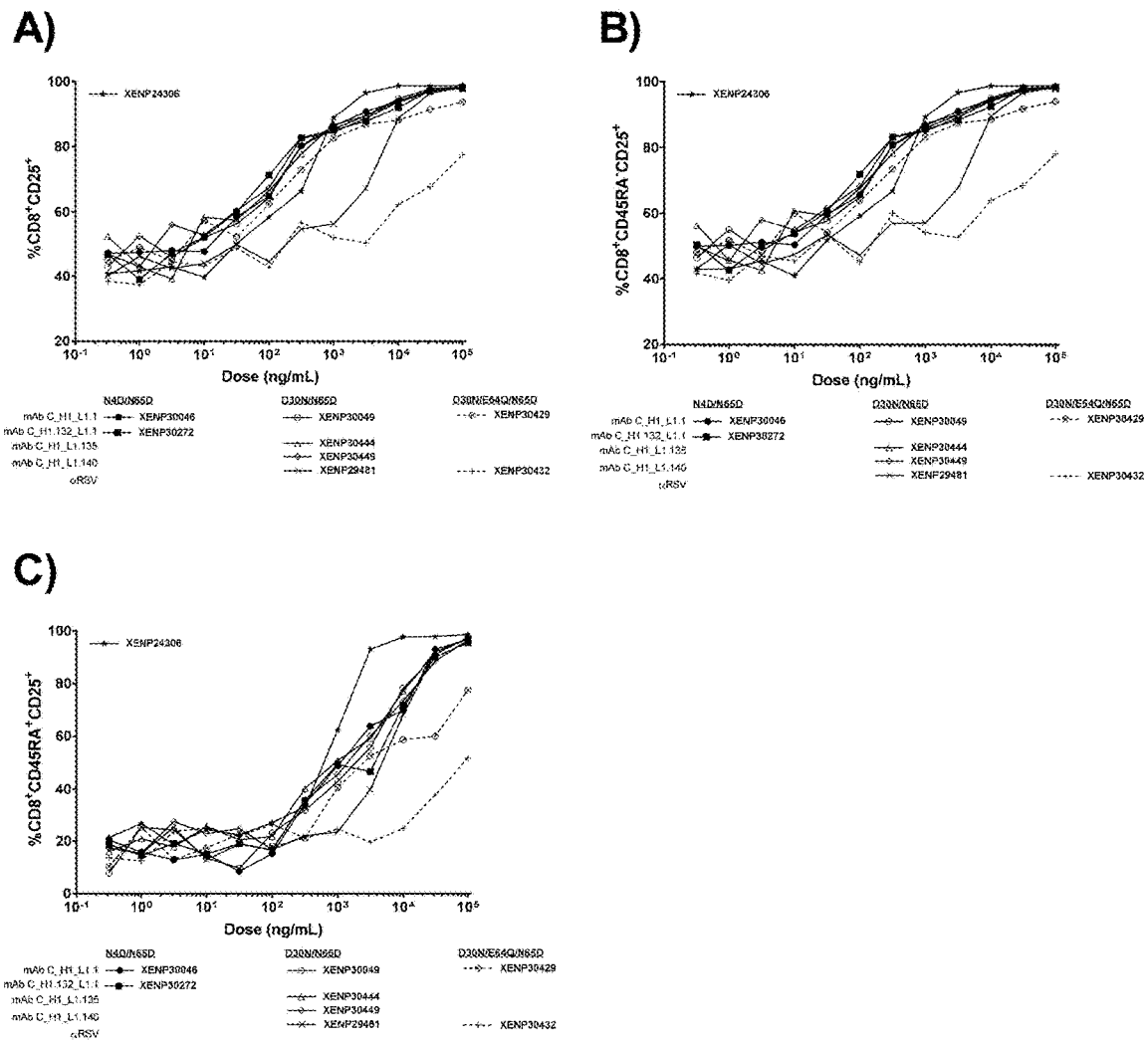

FIG. 82 depicts activation of A) CD8+ T cells, B) CD8+ CD45RA− T cells and C) CD8+CD45RA+ T cells following incubation with [NC]PD-1-targeted IL-15/Rα-Fc fusions with varying PD-1 affinity and IL-15 potency variants (and controls) as indicated by CD25 MFI.

Figure 83:
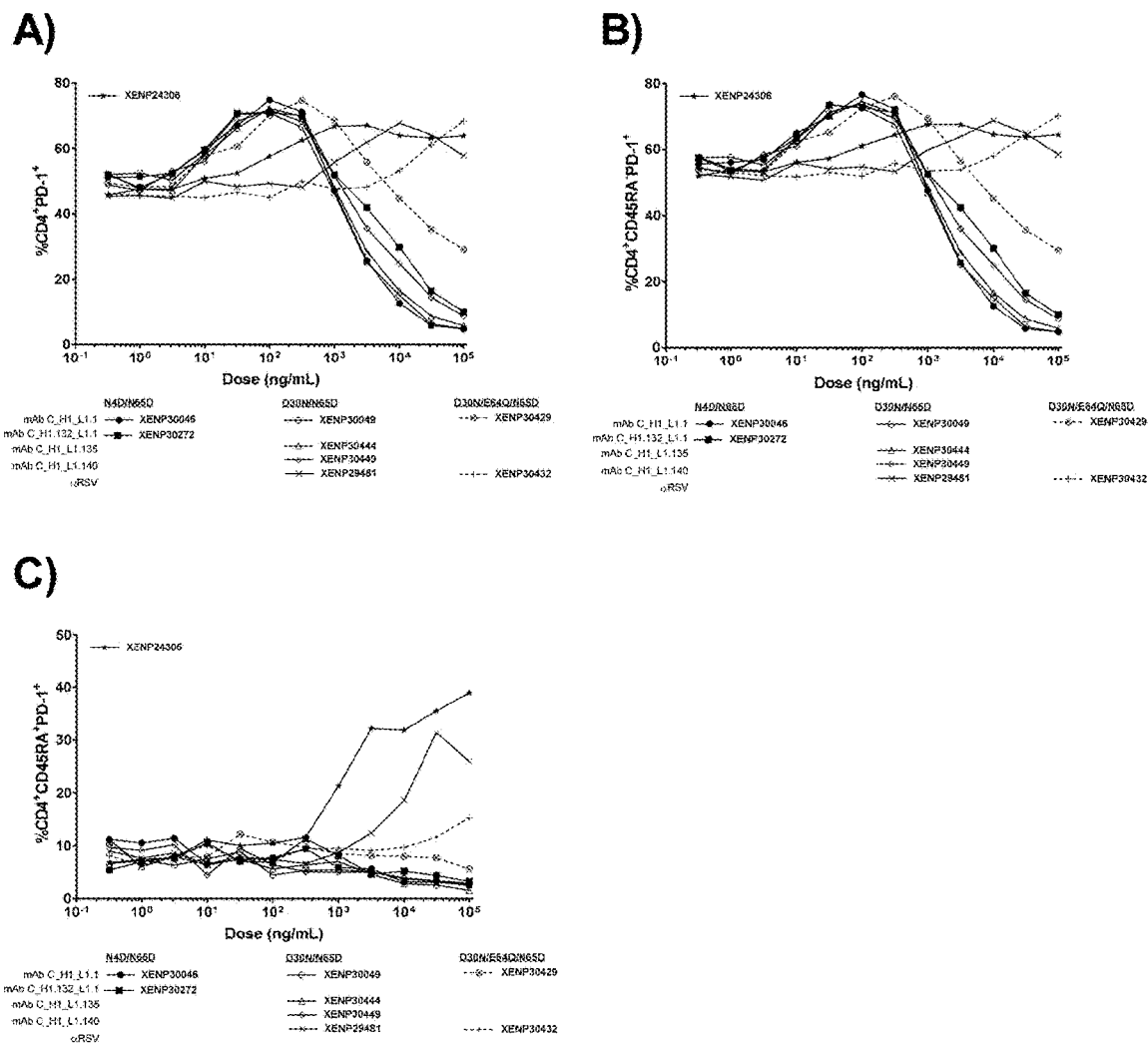

FIG. 83 depicts expression of PD-1 on A) CD4+ T cells, B) CD4+CD45RA− T cells and C) CD4+CD45RA+ T cells following incubation with [NC]PD-1-targeted IL-15/Rα-Fc fusions with varying PD-1 affinity and IL-15 potency variants (and controls) as indicated by PD-1 MFI.

Figure 84:
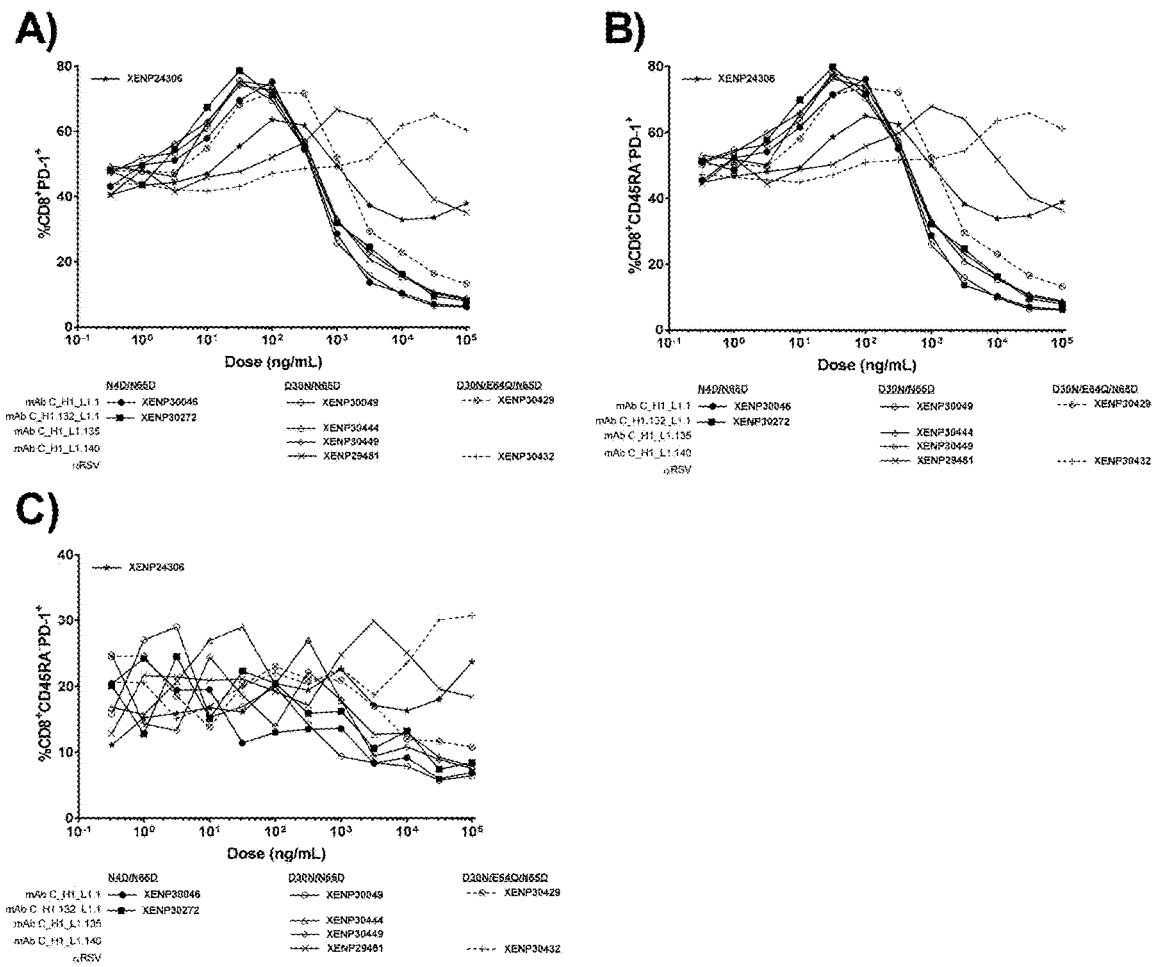

FIG. 84 depicts expression of PD-1 on A) CD8+ T cells, B) CD8+CD45RA− T cells and C) CD8+CD45RA+ T cells following incubation with [NC]PD-1-targeted IL-15/Rα-Fc fusions with varying PD-1 affinity and IL-15 potency variants (and controls) as indicated by PD-1 MFI.

FIG. 85 depicts expansion of A) CD45 cells, B) CD3+ T cells, C) CD4+ T cells, and D) CD8+ T cells in NSG mice (as indicated by cell counts) on Day 10 after first dose with indicated test articles. The data show that higher potency IL-15 results in greater expansion of various lymphocyte populations.

FIG. 86 depicts activation of A) CD4+ T cells and B) CD8+ T cells in NSG mice (as indicated by CD25 staining) on Day 10 after first dose with indicated test articles. The data show that higher potency IL-15 results in greater expansion of various lymphocyte populations.

Figure 87A:
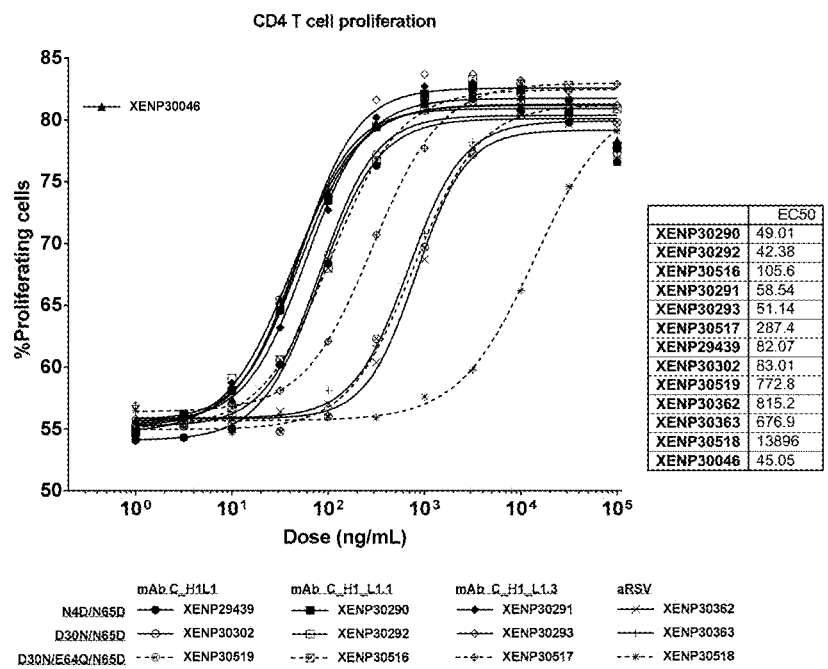
Figure 87B:
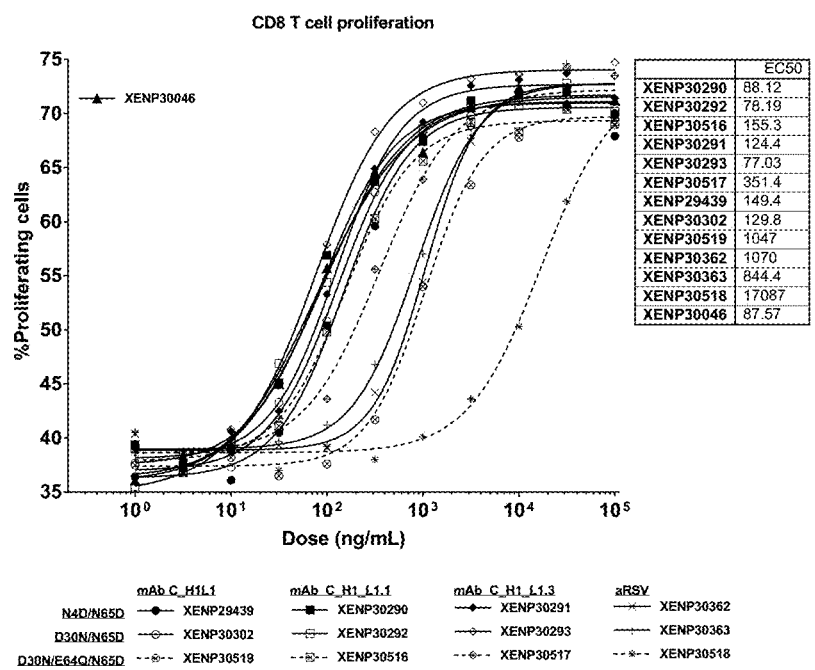
Figure 87C:
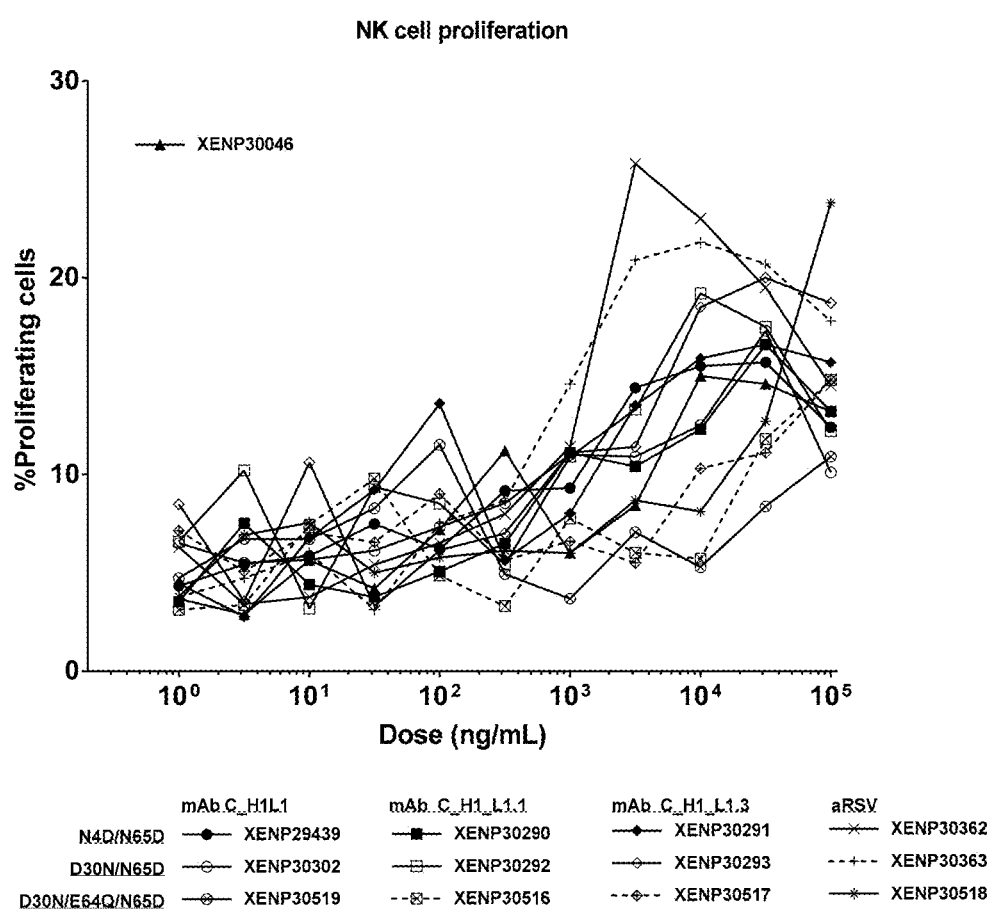

FIGS. 87A-87C depict induction of A) CD4+ T cell proliferation, B) CD8+ T cell, and C) NK cell proliferation by [NC]PD-1-targeted IL-15/Rα-Fc fusions and control RSV-targeted IL-15/Rα-Fc fusions having Xtend Fc as indicated by percentage proliferating cells (determined based on CFSE dilution). Notably, the data shows that the EC50 for XENP30046 is comparable to the EC50 for XENP30290 (the Xtend analog to XENP30046).

Figure 88:
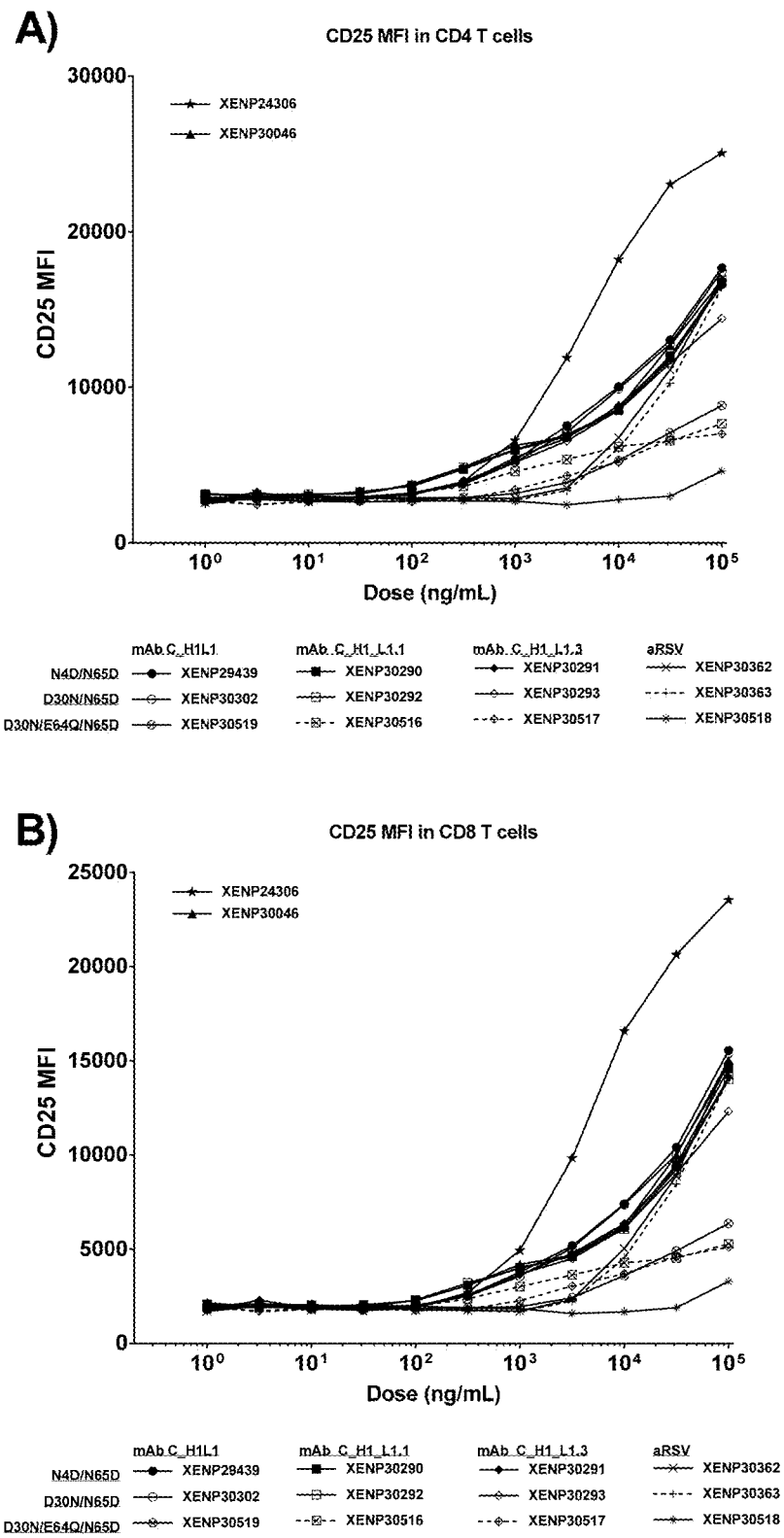

FIG. 88 depicts activation of A) CD4+ T cells and B) CD8+ T cells by [NC]PD-1-targeted IL-15/Rα-Fc fusions and control RSV-targeted IL-15/Rα-Fc fusions having Xtend Fc as indicated by CD25 MFI.

FIG. 89 depicts PD-1 regulation on A) CD4+ T cells and B) CD8+ T cells by [NC]PD-1-targeted IL-15/Rα-Fc fusions and control RSV-targeted IL-15/Rα-Fc fusions having Xtend Fc as indicated by PD-1 MFI. Consistent with Example 9B, the test articles downregulated PD-1 on T cells.

Figure 90:
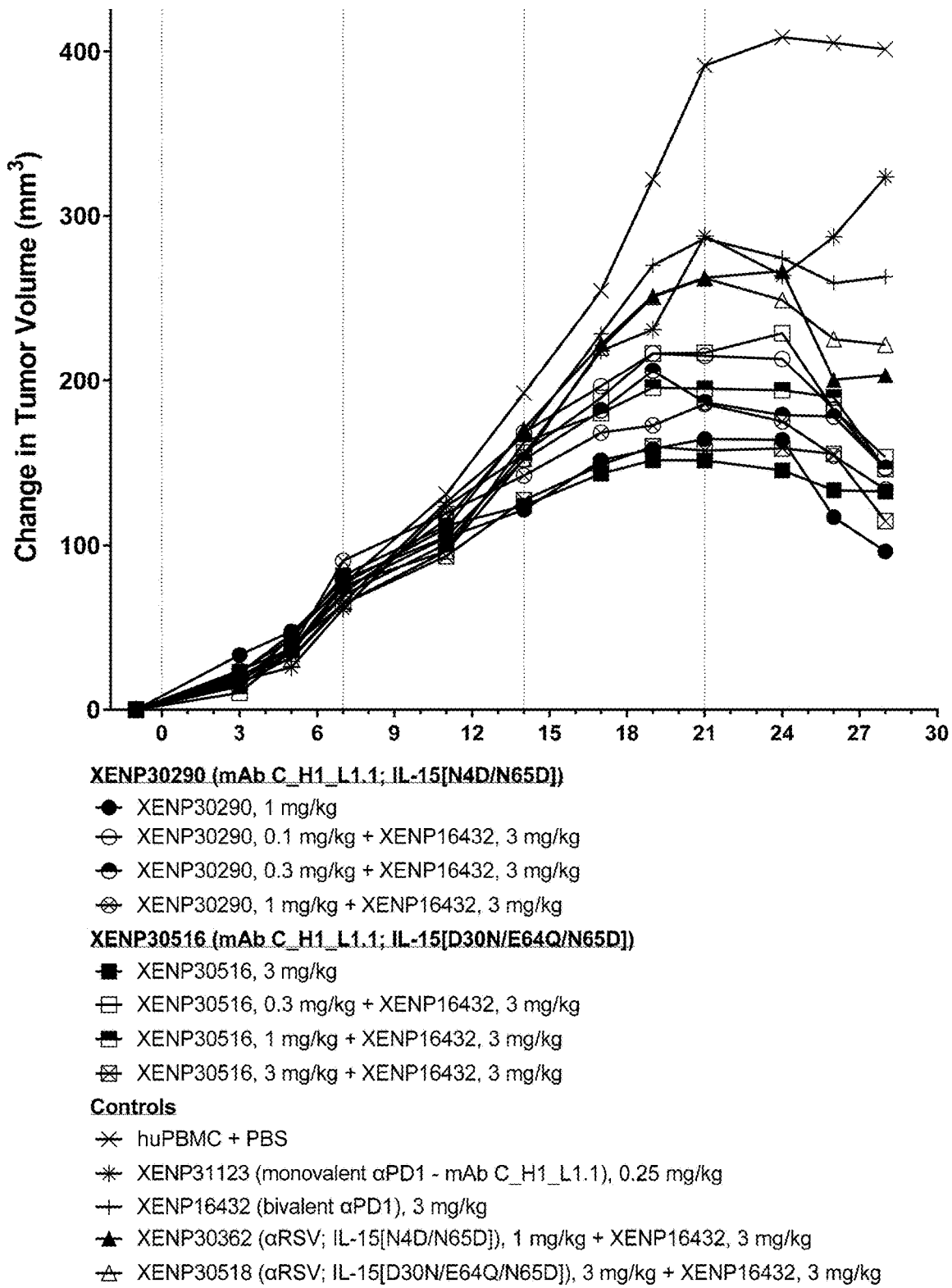
Figures 91A, 91B, 91C, 91D:
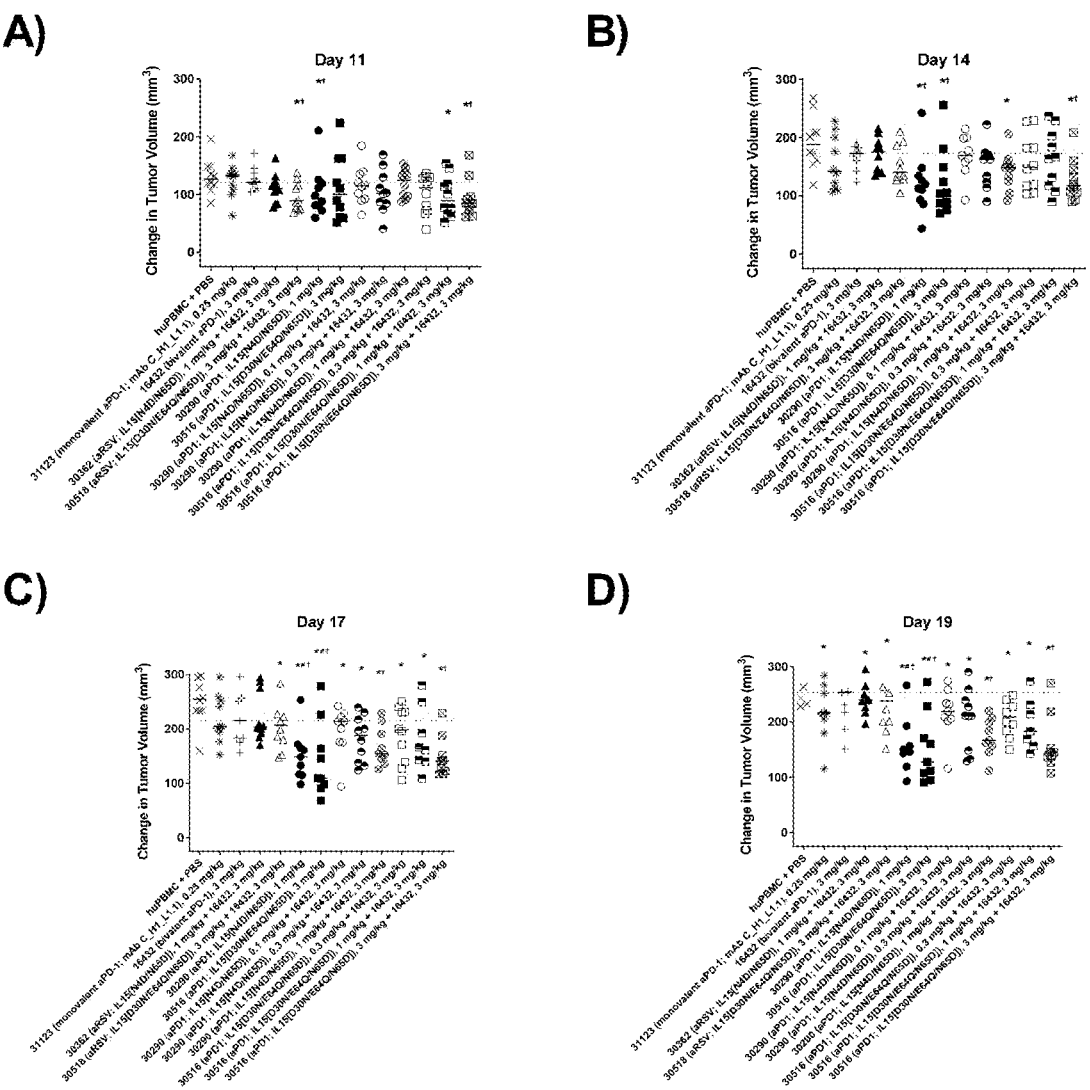
Figures 91E, 91F, 91G, 91H:
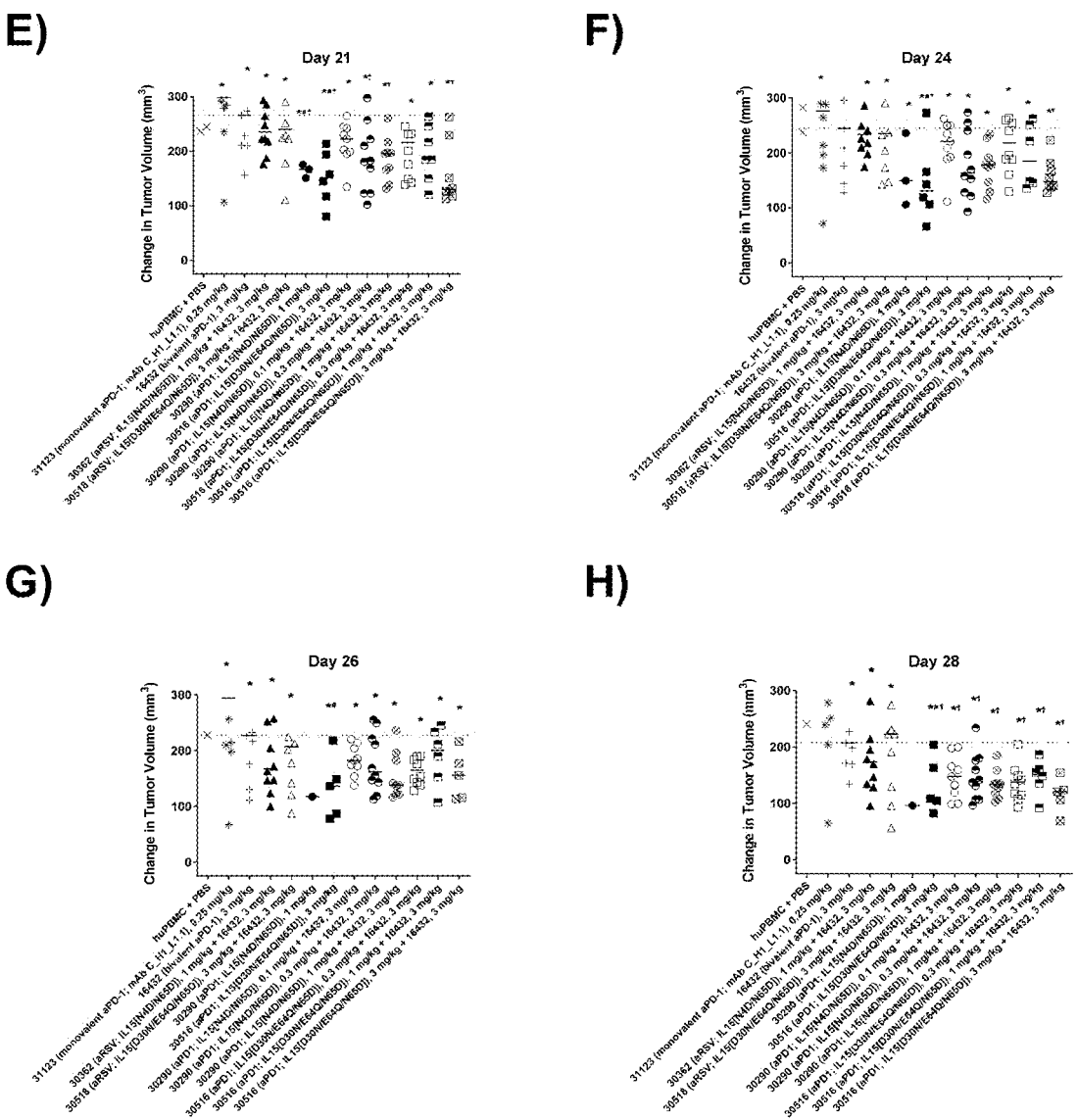
Figures 92A, 92B, 92C:
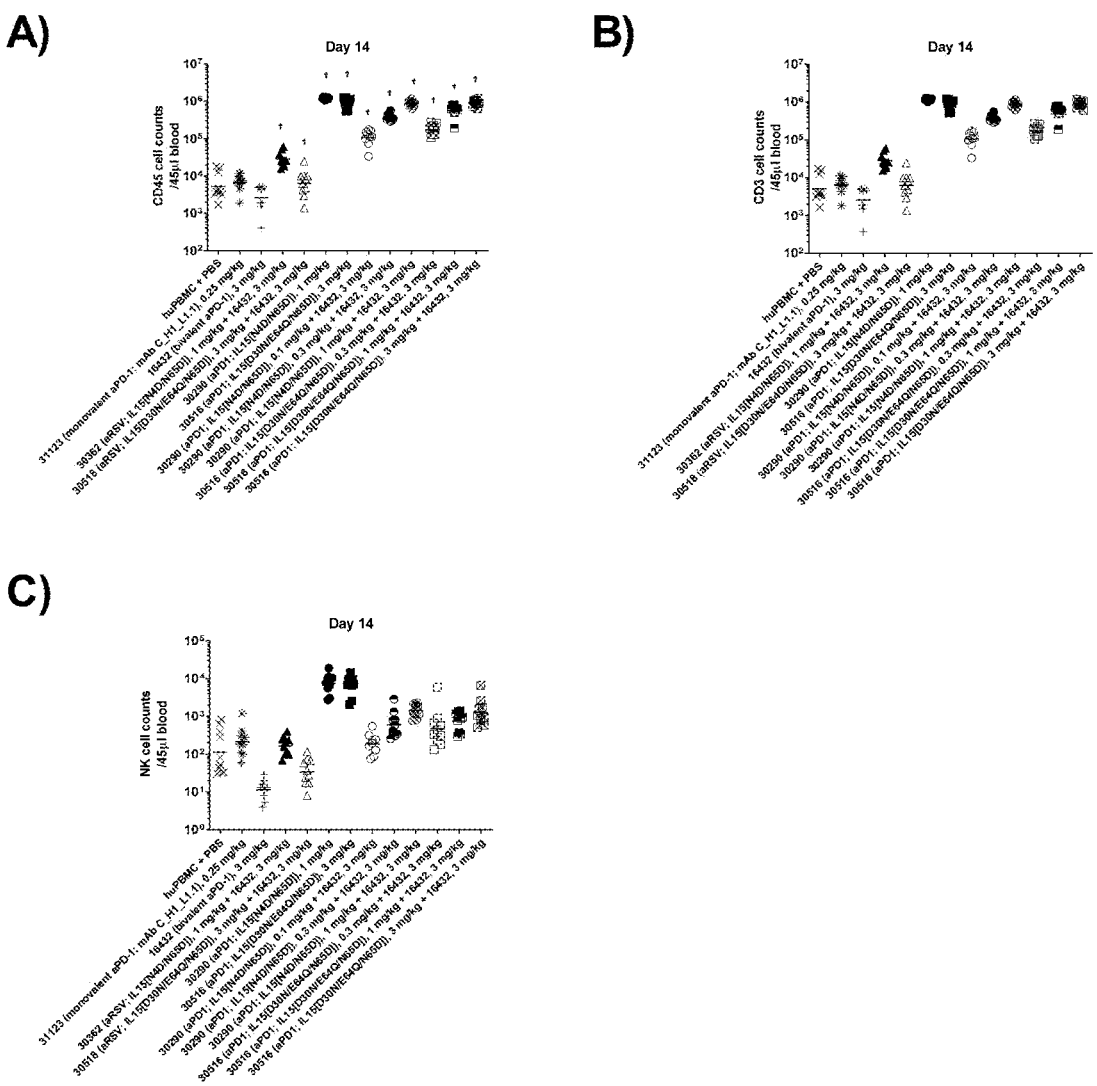
Figures 92D, 92E, 92F:
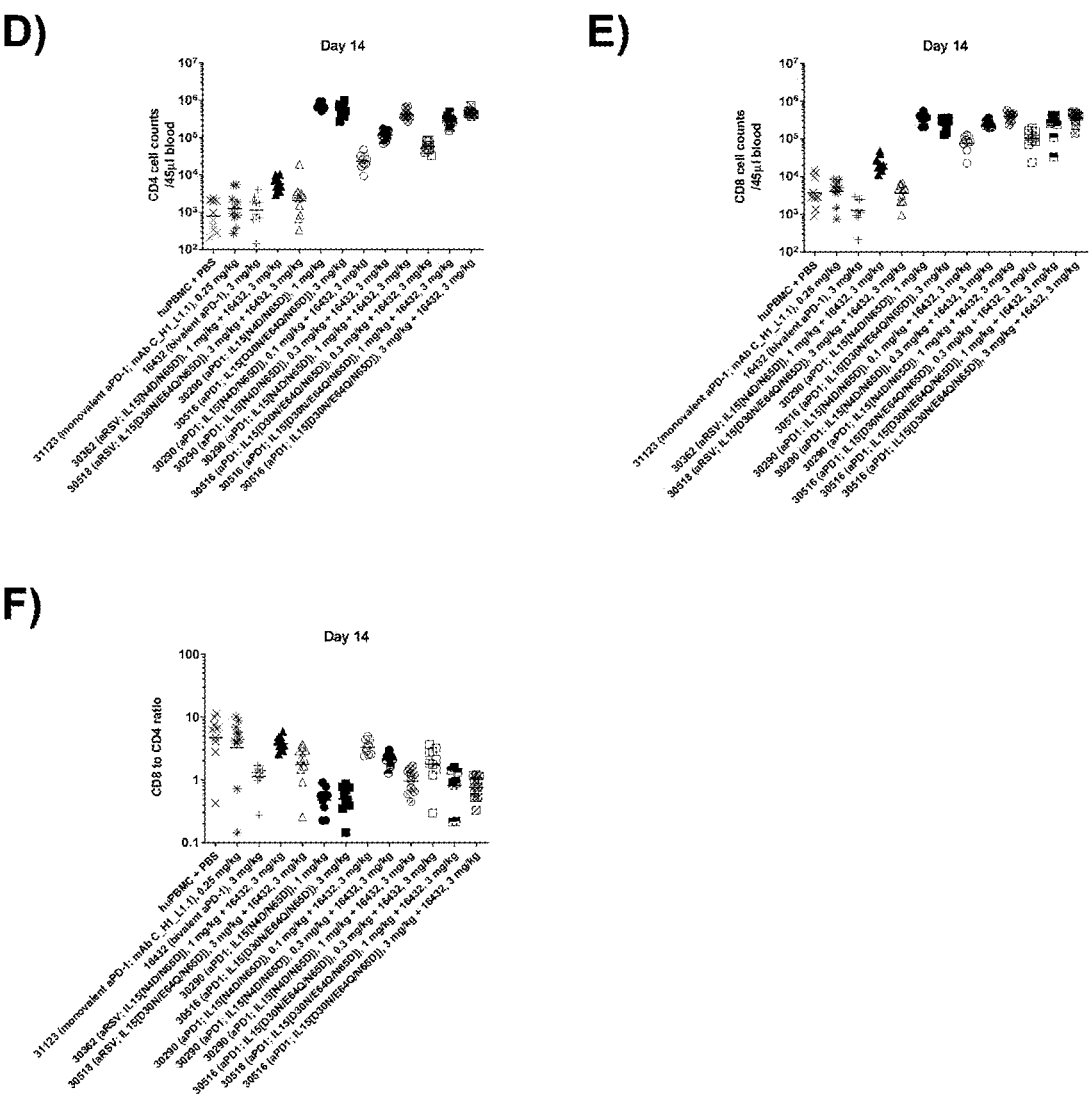
Figures 93A, 93B, 93C:
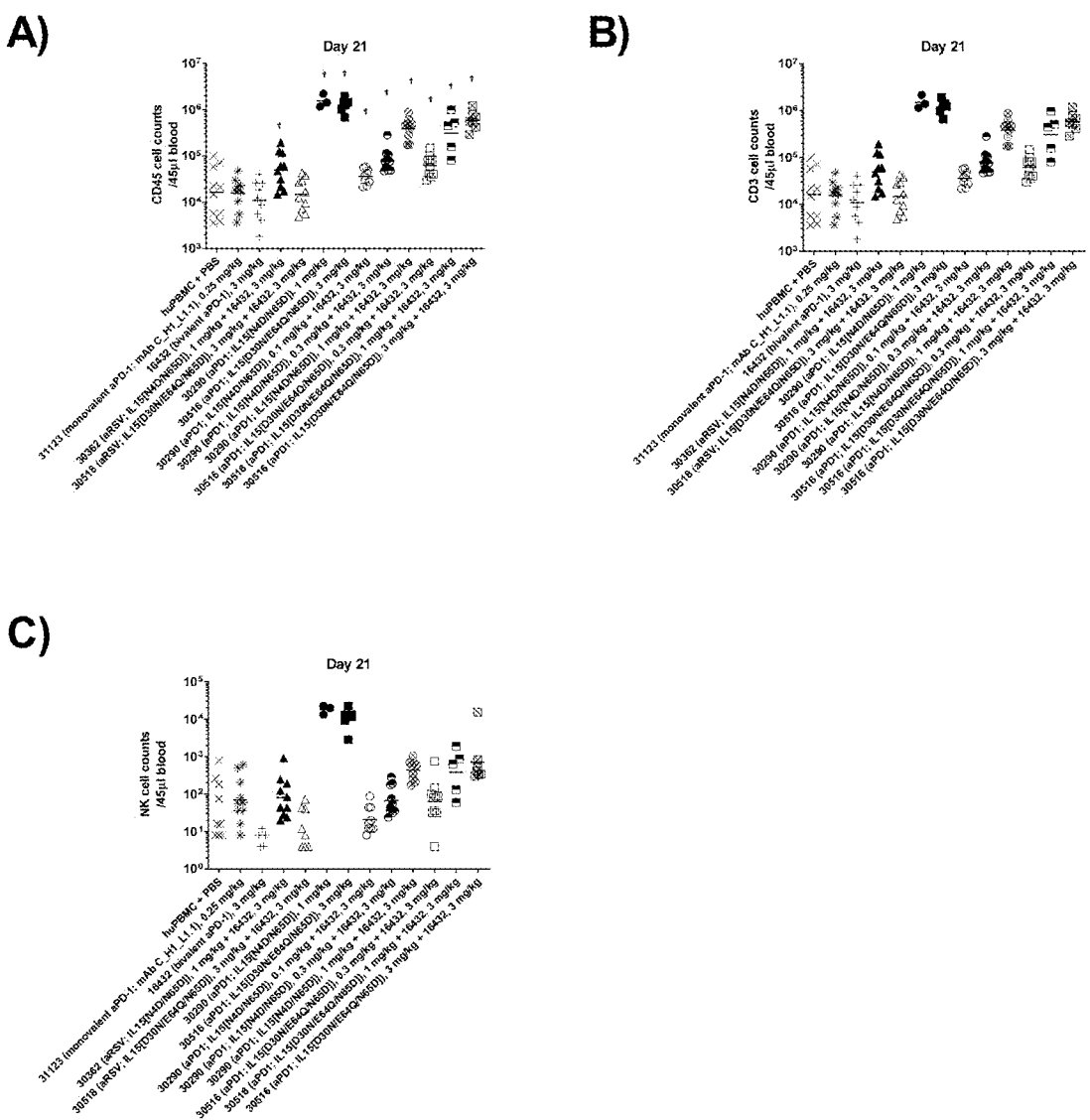
Figures 93D, 93E, 93F:
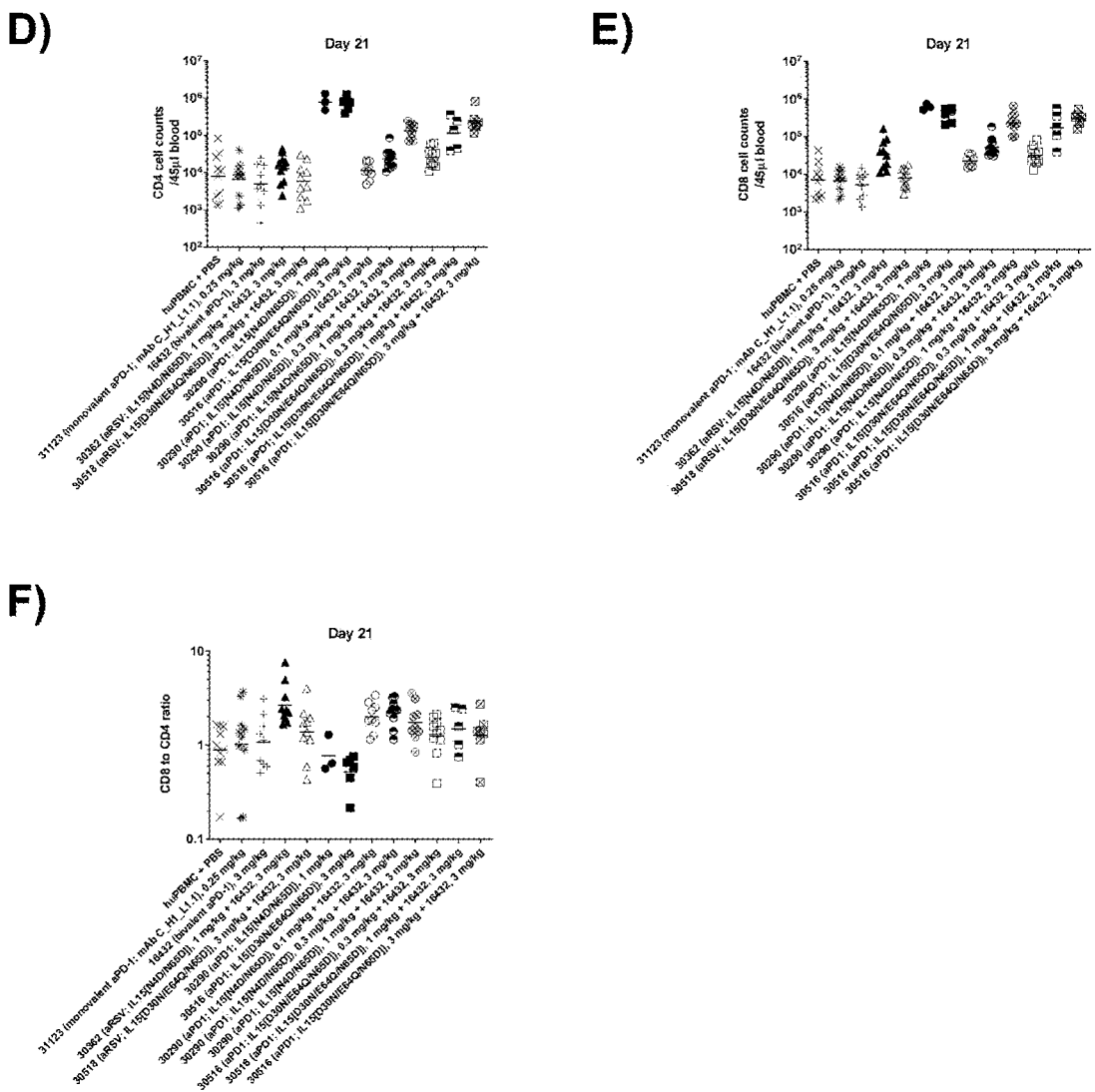

FIG. 90 depicts tumor volume (as determined by caliper measurements) over time in pp65-MCF7 and huPBMC-engrafted NSG mice dosed with [NC]PD-1-targeted IL-15/ Rα-Fc fusions, alone or in combination with PD-1 blockade.

FIG. 91A-91H depicts tumor volume (as determined by caliper measurements) on Days 11, 14, 17, 19, 21, 24, 26, and 28 (post PBMC engraftment and first dose of test articles) in pp65-MCF7 and huPBMC-engrafted NSG mice dosed with [NC]PD-1-targeted IL-15/Rα-Fc fusions, alone or in combination with PD-1 blockade. Statistics were performed on baseline corrected data using Mann-Whitney test. * indicates that treatment significantly (p<0.05) enhanced expansion in comparison to PBS control. # indicates that treatment significantly (p<0.05) enhanced expansion in comparison to treatment with XENP31123. † indicates that treatment significantly (p<0.05) enhanced expansion in comparison to PD-1 blockade (XENP16432) alone. The data show that by Day 28, all combinations of XENP30290 (0.1, 0.3, or 1 mg/kg) or XENP30516 (0.3, 1, or 3 mg/kg) with PD-1 blockade effected significantly reduced tumor size over treatment with PD-1 blockade alone.

FIG. 92A-92F depicts number of human A) CD45+ cells, B) CD3+ T cells, C) NK cells, D) CD4+ T cells, and E) CD8+ T cells, as well as F) CD8 to CD4 T cell ratio in blood of pp65-MCF7 and huPBMC-engrafted NSG mice on Day 14 after first dose with indicated test articles. Statistics for CD45+ cell expansion performed on log-transformed data using unpaired t-test. † indicates that treatment significantly enhanced expansion in comparison to PD-1 blockade (XENP16432) alone.

FIG. 93A-93F depicts number of human A) CD45+ cells, B) CD3+ T cells, C) NK cells, D) CD4+ T cells, and E) CD8+ T cells, as well as F) CD8 to CD4 T cell ratio in blood of pp65-MCF7 and huPBMC-engrafted NSG mice on Day 21 after first dose with indicated test articles. † indicates that treatment significantly enhanced expansion in comparison to PD-1 blockade (XENP16432) alone.

Figure 94:
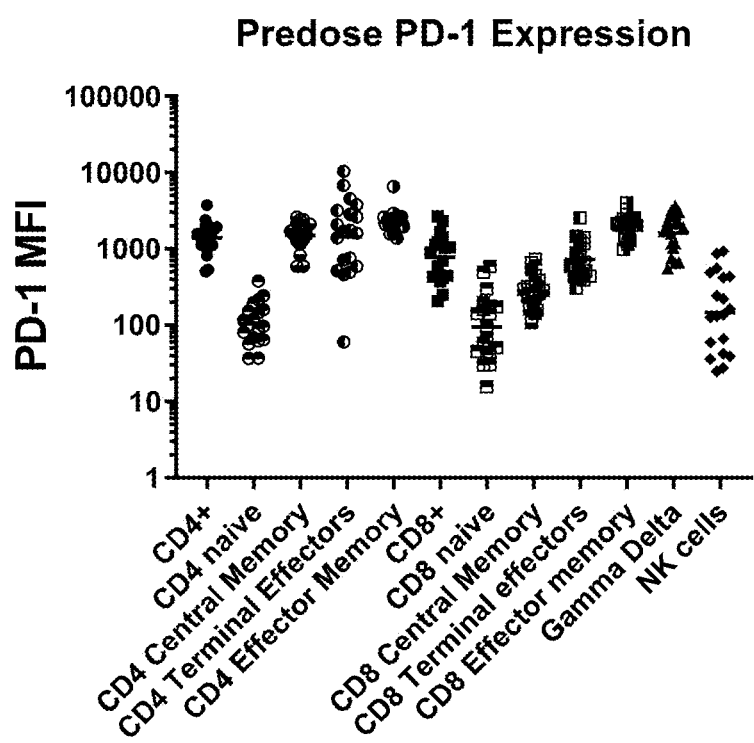

FIG. 94 depicts the PD-1 expression level (as indicated by MFI) on various lymphocyte populations in CD34+ Hu-NSG mice (prior to treatment with any test articles). The data show that the mice have a PD-1 expression profile similar to humans i.e. higher expression on effector memory populations.

Figure 95:
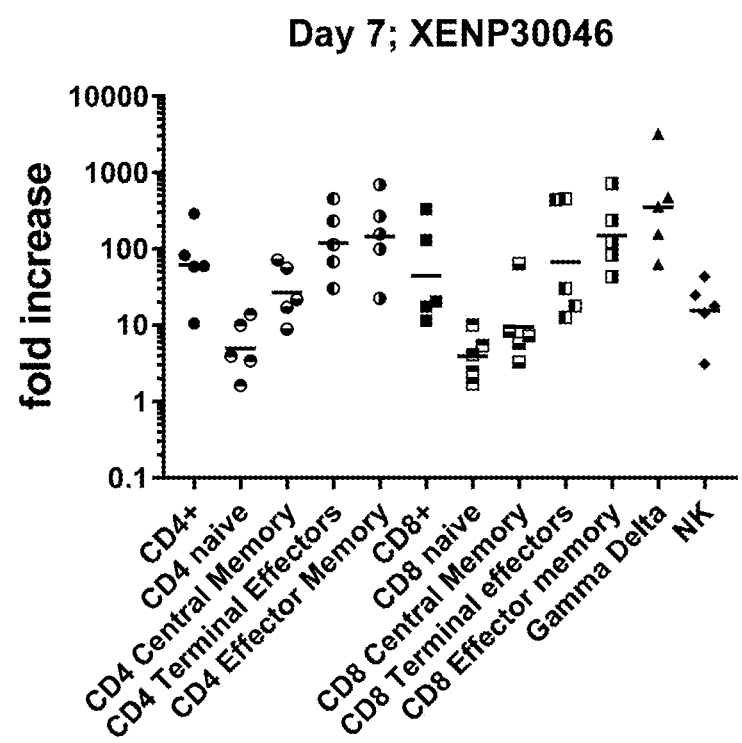

FIG. 95 depicts the fold increase in various lymphocyte populations in CD34+ Hu-NSG mice on Day 7 after treatment with 0.3 mg/kg XENP30046 ([NC]PD-1-targeted IL-15/Rα-Fc comprising mAb C_H1_L1.1 and IL-15(N4D/N65D) variant). XENP30046 shows over 100-fold expansion in effector memory populations.

Figure 96:
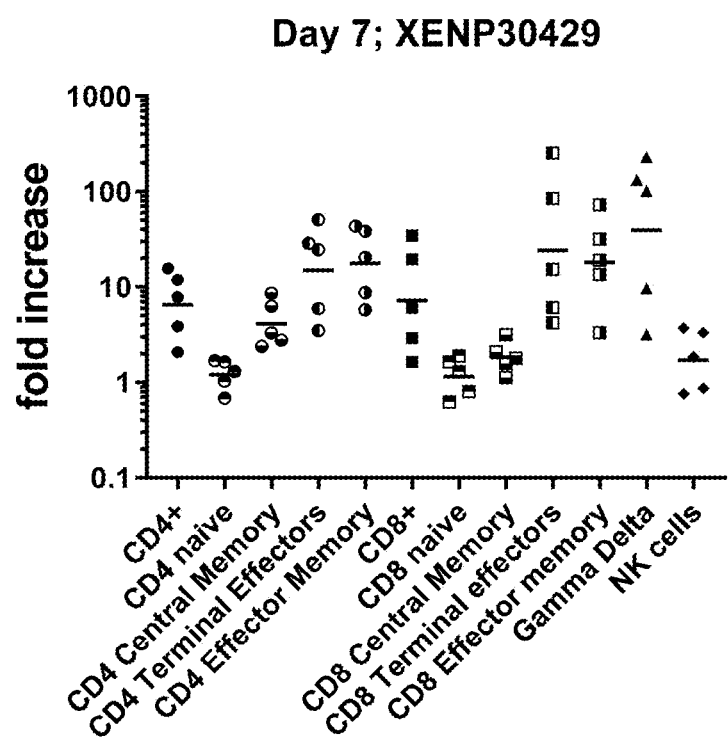

FIG. 96 depicts the fold increase in various lymphocyte populations in CD34+ Hu-NSG mice on Day 7 after treatment with 0.3 mg/kg XENP30429 ([NC]PD-1-targeted IL-15/Rα-Fc comprising mAb C_H1_L1.1 and IL-15 (D30N/E64Q/N65D) variant).

Figure 97:
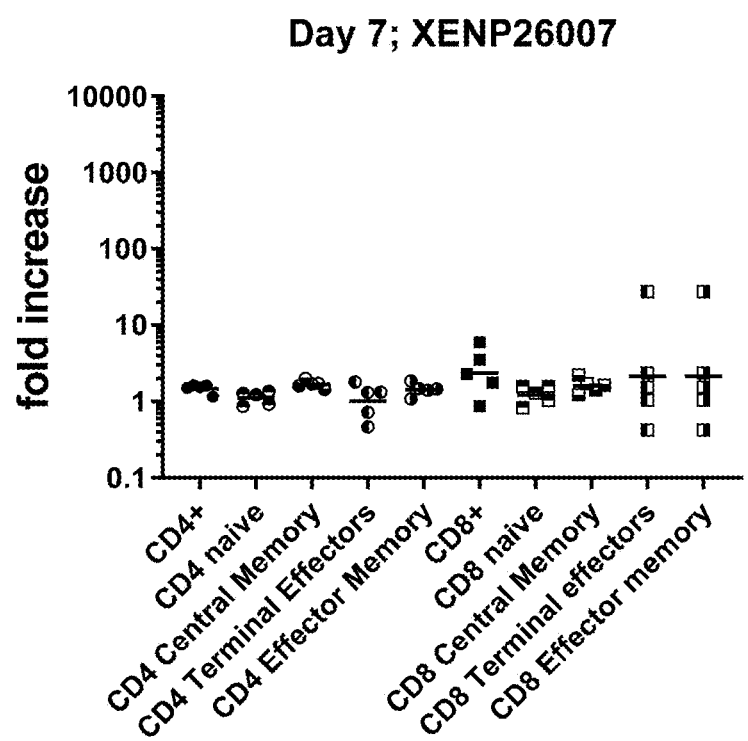

FIG. 97 depicts the fold increase in various lymphocyte populations in CD34+ Hu-NSG mice on Day 7 after treatment with 0.3 mg/kg XENP26007 (control RSV-targeted IL-15/Rα-Fc comprising IL-15(N4D/N65D) variant). XENP26007 shows very low expansion of the various lymphocyte populations indicating that the PD-1-targeted IL-15/Rα-Fc fusions would have minimal peripheral lymphocyte expansion.

Figure 98:
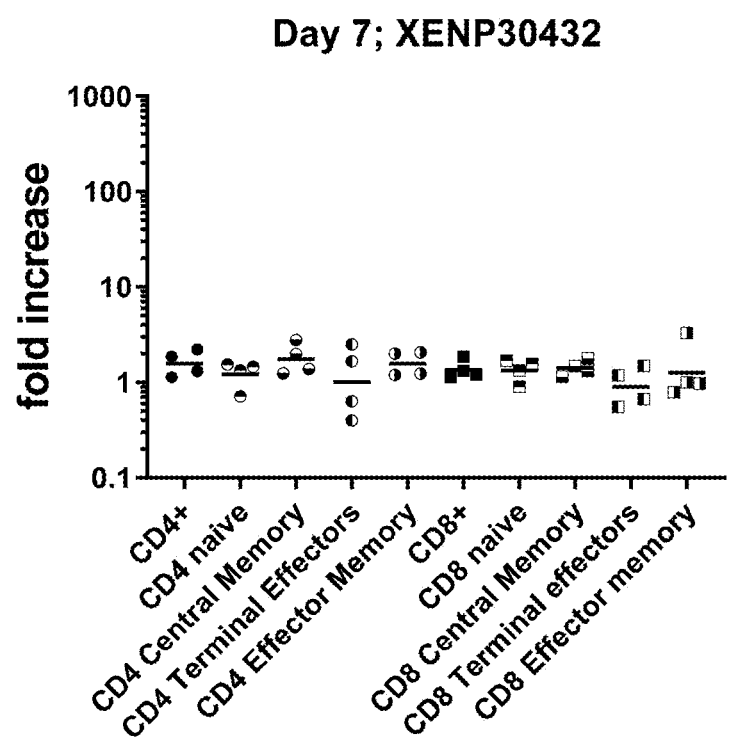

FIG. 98 depicts the fold increase in various lymphocyte populations in CD34+ Hu-NSG mice on Day 7 after treatment with 0.3 mg/kg XENP30432 (control RSV-targeted IL-15/Rα-Fc comprising IL-15(D30N/E64Q/N65D) variant). XENP30432 shows very low expansion of the various lymphocyte populations indicating that the PD-1-targeted IL-15/Rα-Fc fusions would have minimal peripheral lymphocyte expansion.

Figure 99:
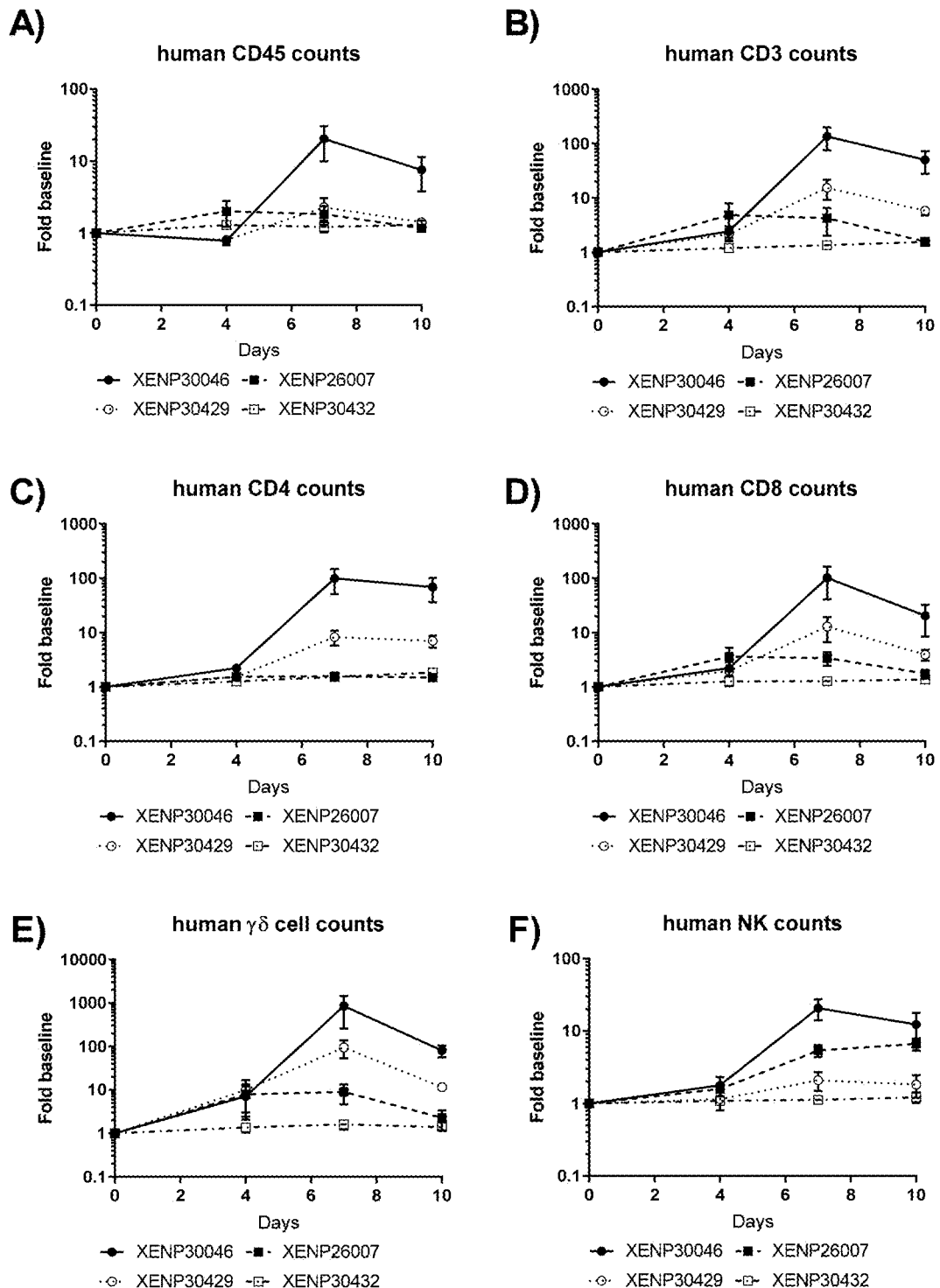

FIG. 99 depicts the fold change in A) CD45 cells, B) CD3+ cells, C) CD4+ cells, D) CD8+ cells, E) γδ cells, and F) NK cells in CD34+ Hu-NSG mice over time after treatment with 0.3 mg/kg XENP30046, XENP30429, XENP26007, or XENP30432.

Figure 100:
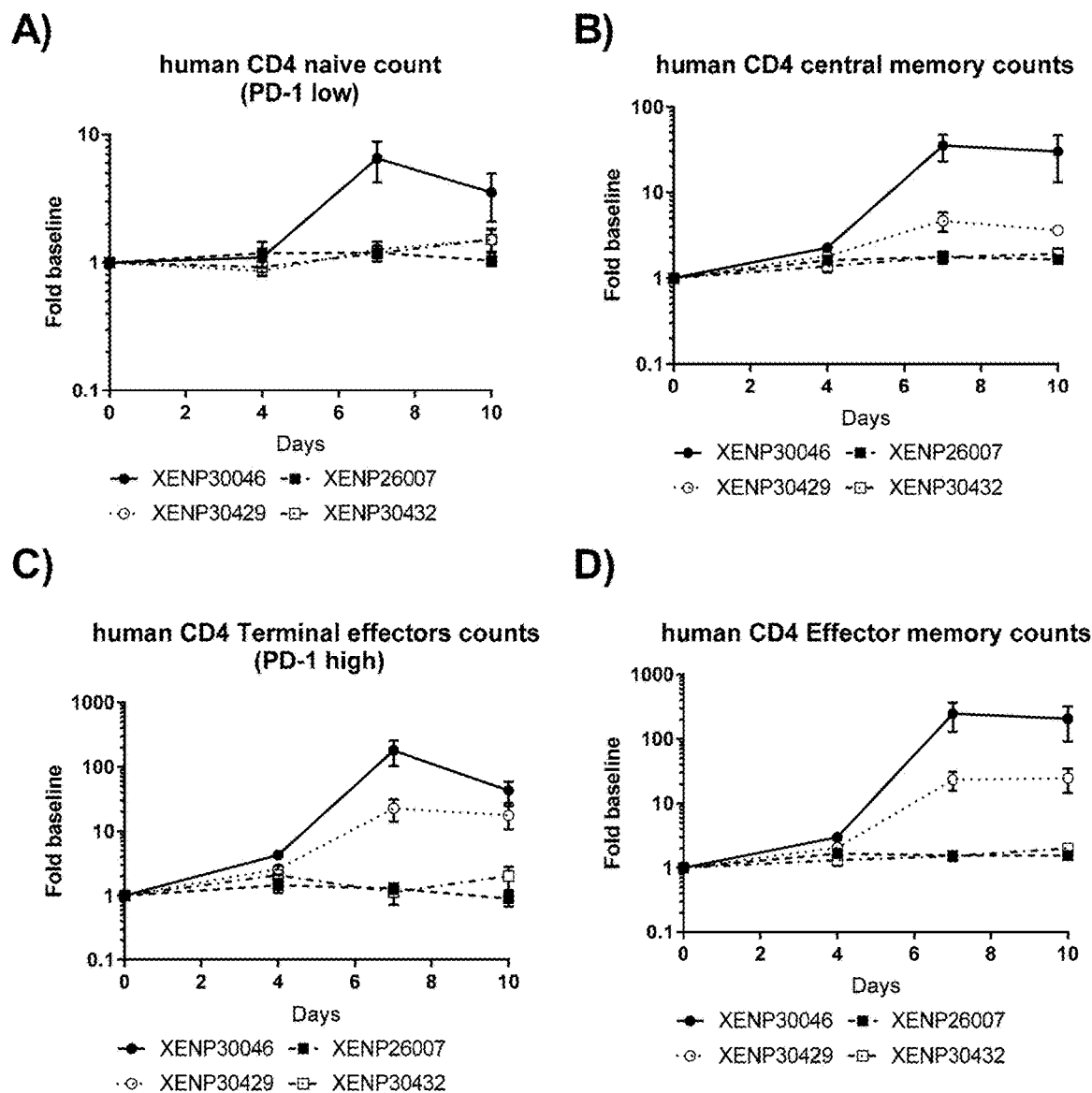

FIG. 100 depicts the fold change in A) CD4 naive cells, B) CD4 central memory cells, C) CD4 terminal effector cells, and D) CD4 effector memory cells in CD34+ Hu-NSG mice over time after treatment with 0.3 mg/kg XENP30046, XENP30429, XENP26007, or XENP30432. The data show that XENP30046 and XENP30429 are selective for PD-1+ populations such as CD4 effector memory cells. Notably, XENP30429 expansion of CD4 naïve cells was minimal indicating that reducing potency of the IL-15 arm improves selectivity.

Figure 101:
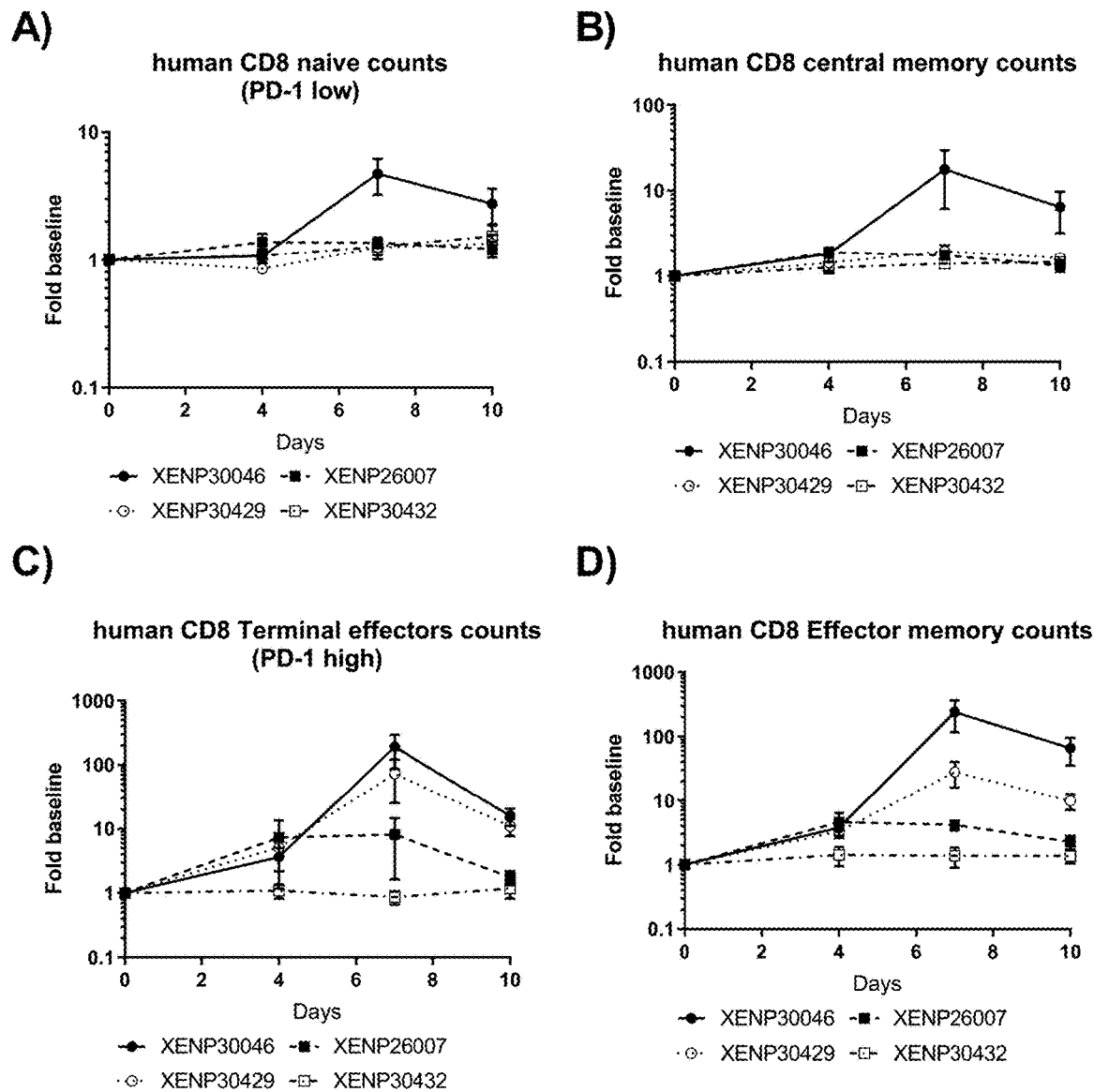

FIG. 101 depicts the fold change in A) CD8 naive cells, B) CD8 central memory cells, C) CD8 terminal effector cells, and D) CD8 effector memory cells in CD34+ Hu-NSG mice over time after treatment with 0.3 mg/kg XENP30046, XENP30429, XENP26007, or XENP30432. The data show that XENP30046 and XENP30429 are selective for PD-1+ populations such as CD8 effector memory cells. Notably, XENP30429 expansion of CD8 naïve cells was minimal indicating that reducing potency of the IL-15 arm improves selectivity.

Figure 102A:
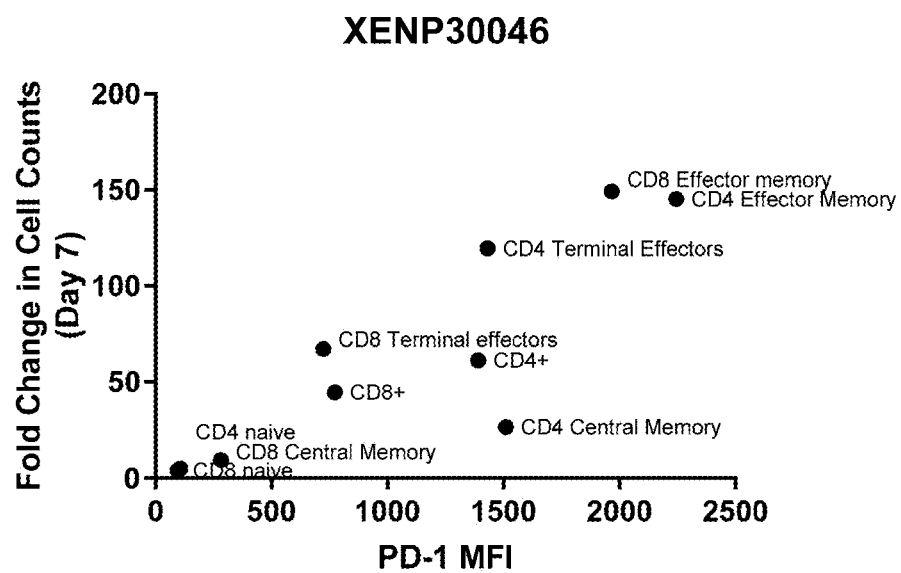
Figure 102B:
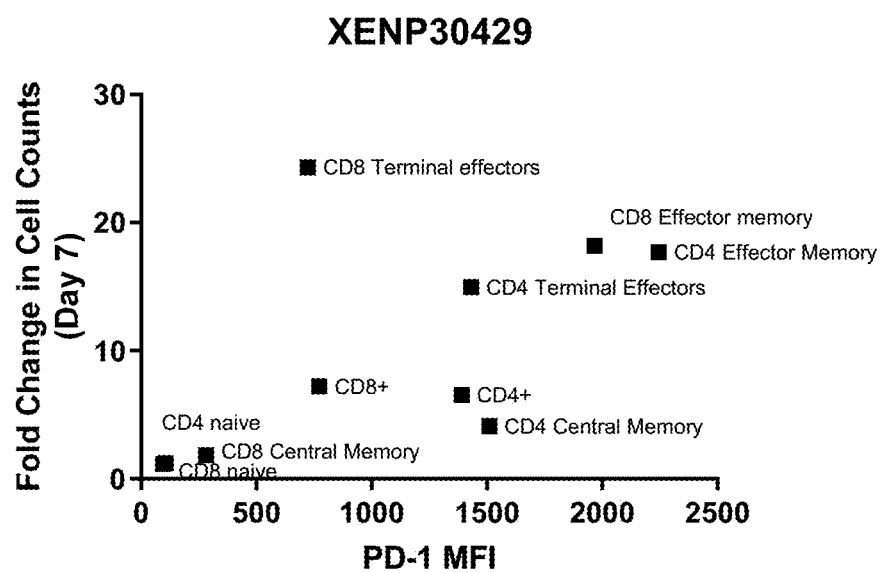
Figure 105A:
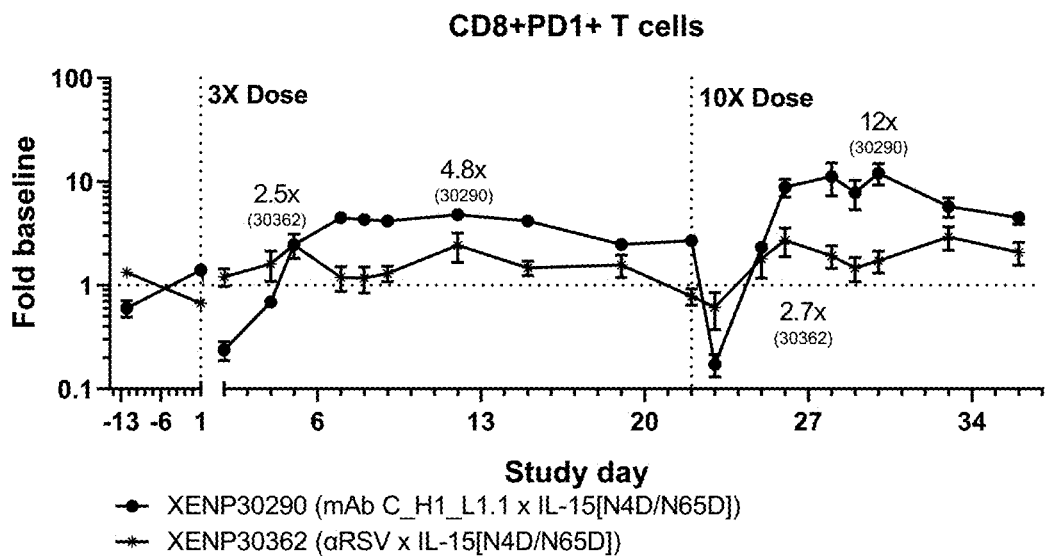
Figure 105B:
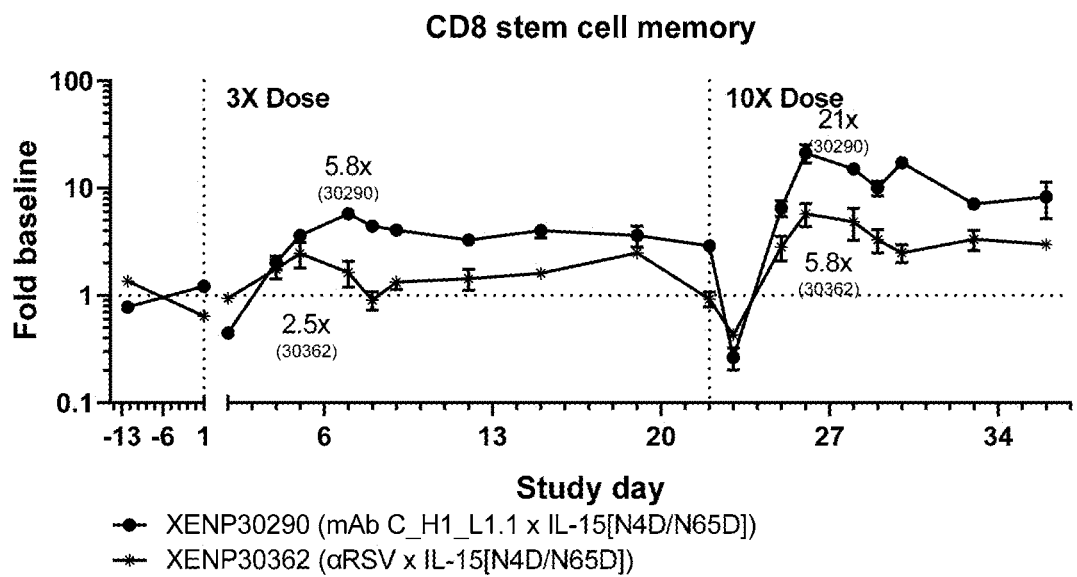
Figure 105C:
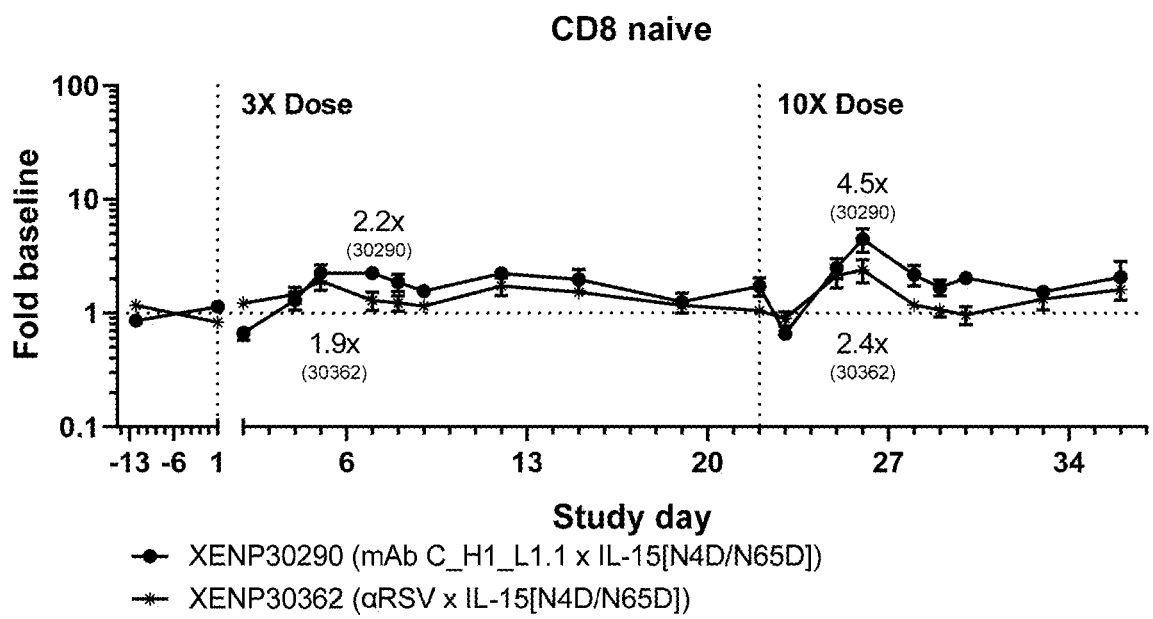
Figure 105D:
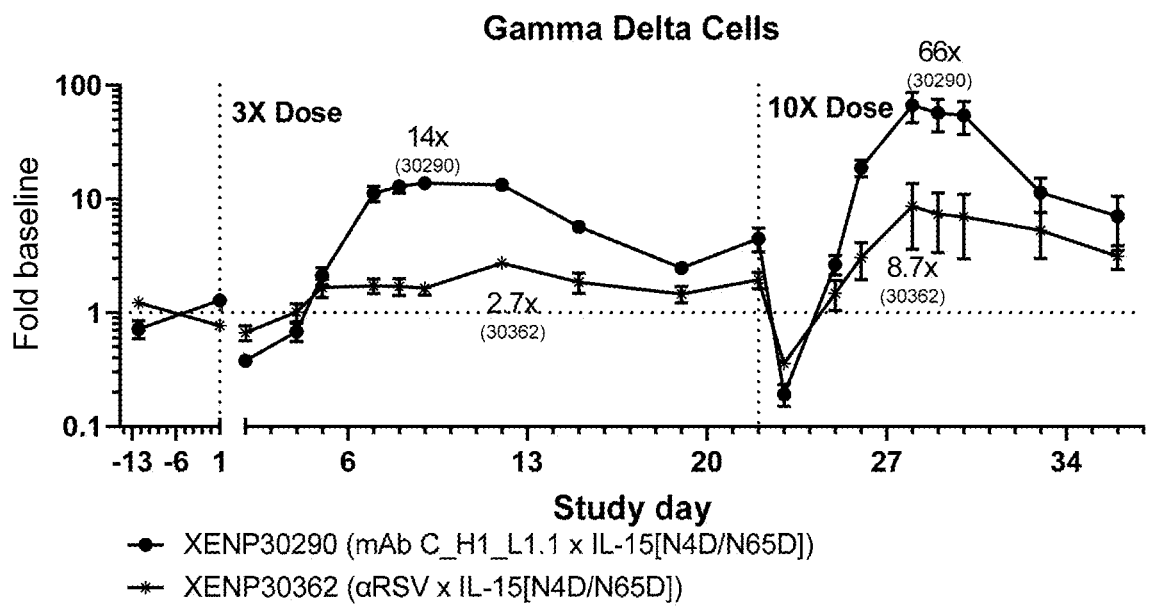
Figure 105E:
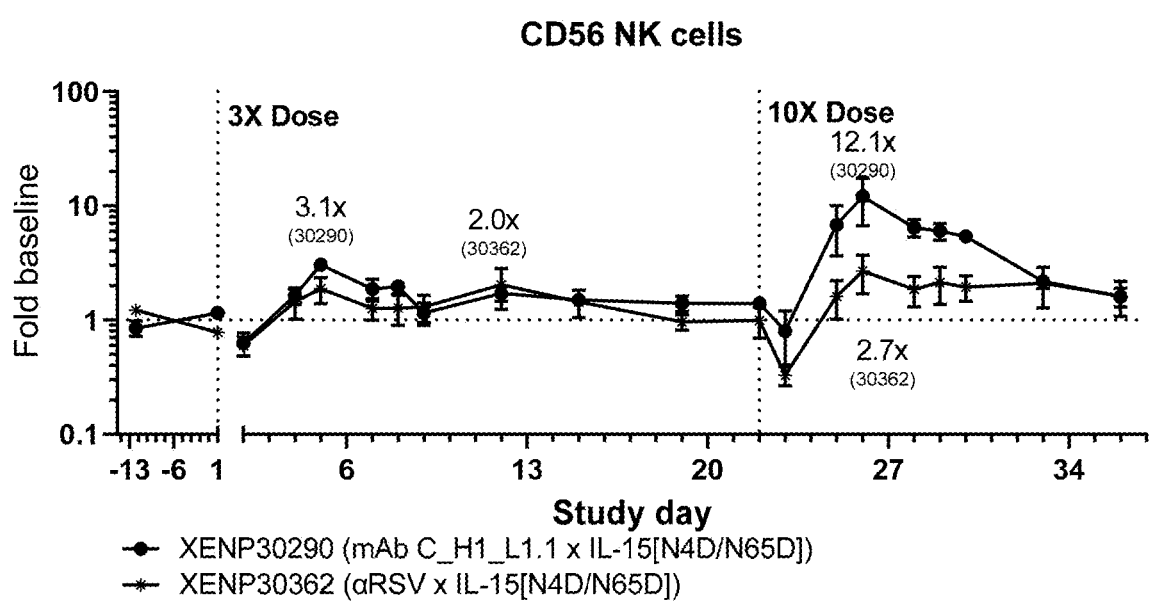
Figure 106A:
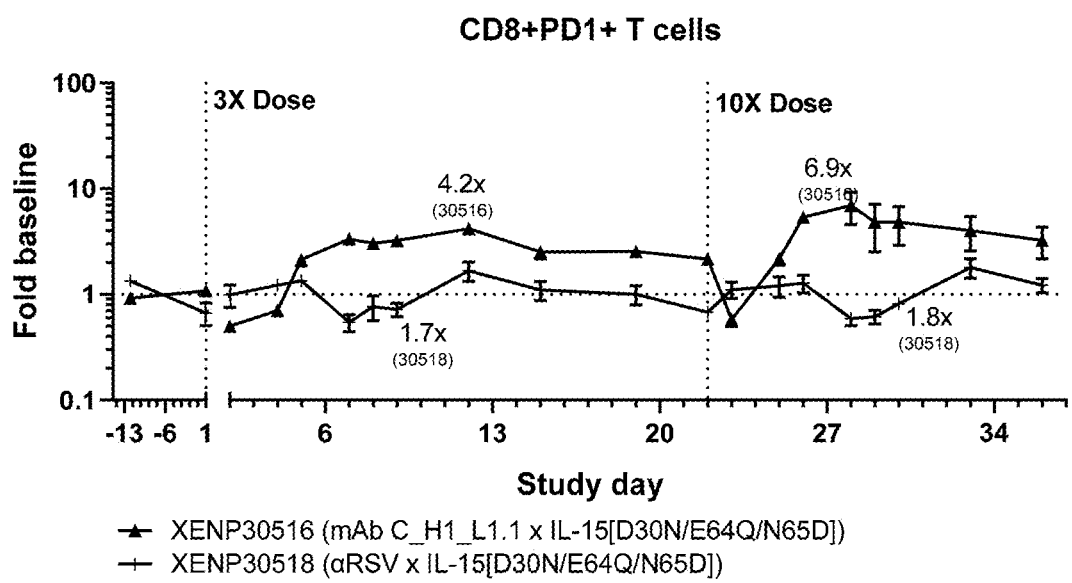
Figure 106B:
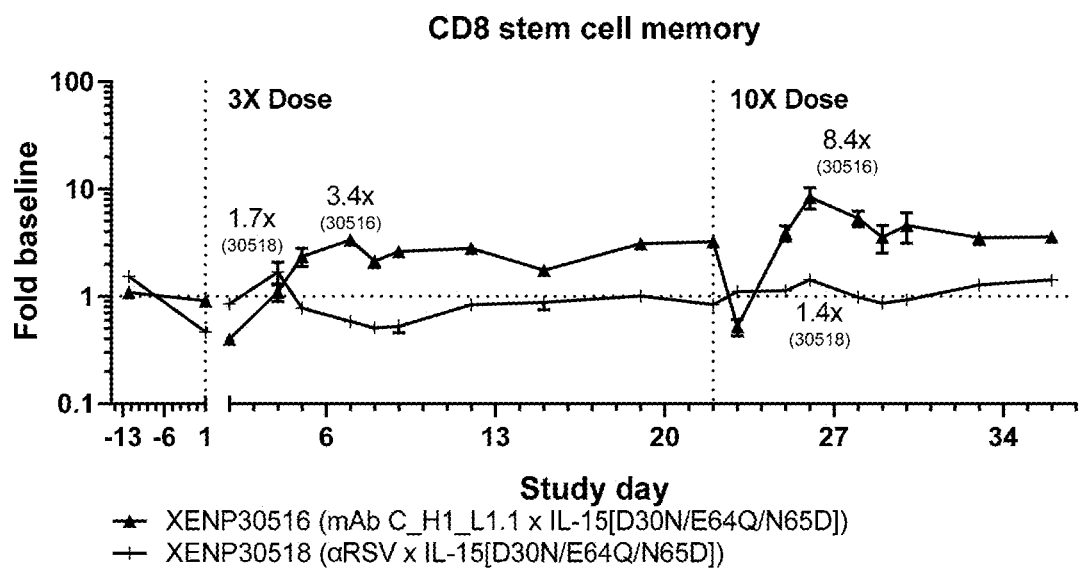
Figure 106C:
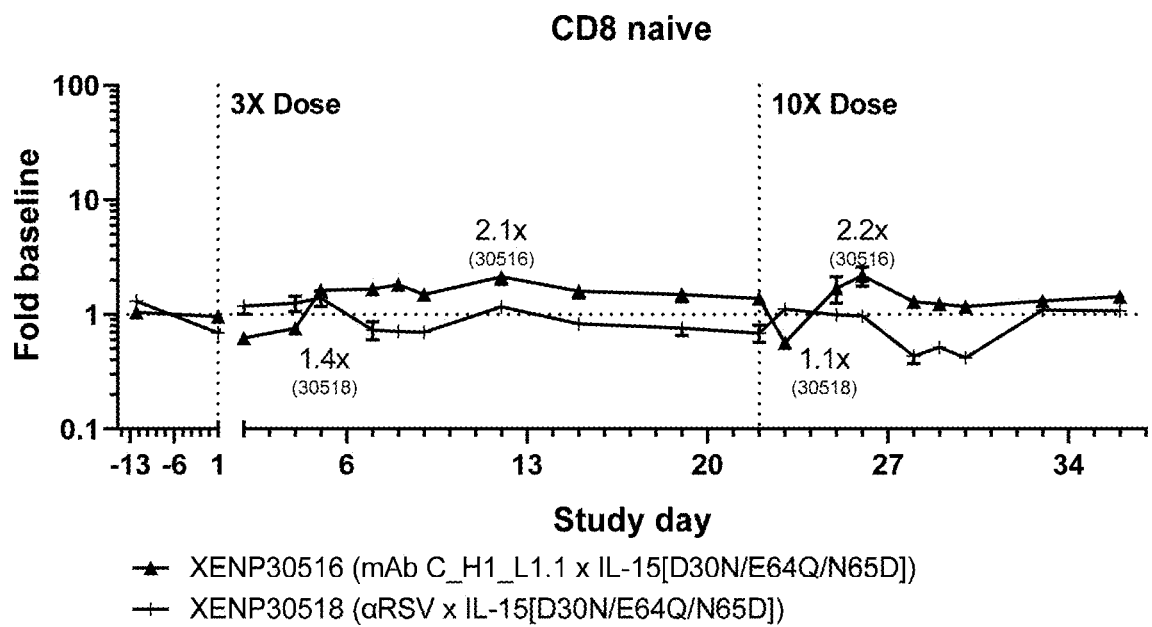
Figure 106D:
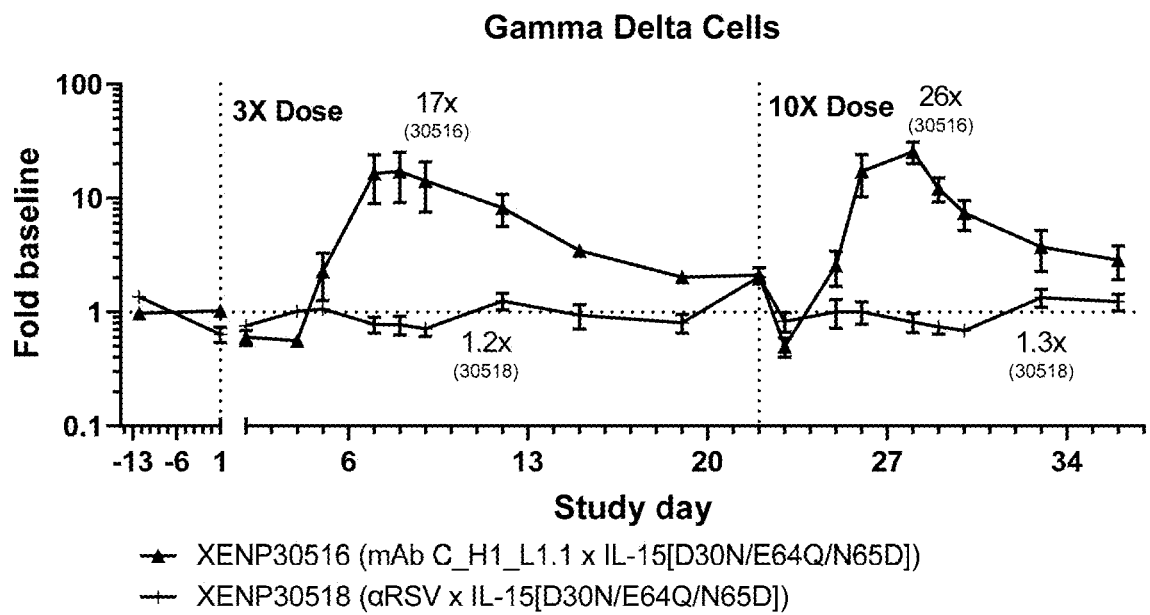
Figure 106E:
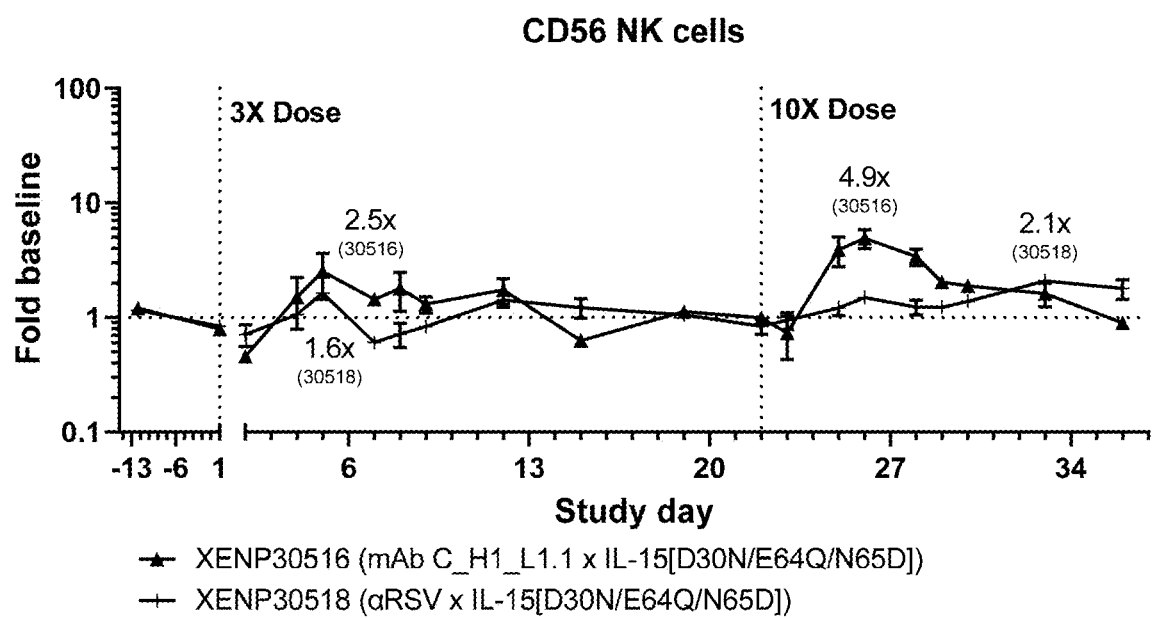

FIG. 102A-102B depicts the correlation between lymphocyte expansion and baseline PD-1 expression in CD34+ Hu-NSG mice on Day 7 after treatment with A) 0.3 mg/kg XENP30046 or B) 0.3 mg/kg XENP30429.

FIG. 103 depicts expansion of A) CD8+ T cells and B) NK cells in cynomolgus monkeys dosed with 0.3×XENP22853, 1×XENP25937, or 0.3×XENP24306. The data show that the PD-1-targeted IL-15/Rα-Fc fusion decreases NK cell expansion while maintaining CD8+ T cell expansion.

FIG. 104 depicts expansion of A) CD8+ naïve T cells and B) CD8+ effector memory T cells in cynomolgus monkeys dosed with 0.3×XENP22853, 1×XENP25937, or 0.3× XENP24306. The data show that the PD-1-targeted IL-15/Rα-Fc fusion selectively expands CD8+ effector memory T cells.

FIG. 105A-105E depicts the expansion of A) CD8+PD1+ T cells, B) CD8 stem cell memory, C) CD8 naive, D) γδ T cells, and E) CD56+ NK cells in cynomolgus monkeys following administration with either XENP30290 (mAb C_H1_L1.1×IL-15[N4D/N65D]) or XENP30362 (αRSV× IL-15[N4D/N65D]). Collectively, the data show that XENP30290 (having high PD-1 affinity and higher IL-15 potency) enabled sustained peripheral pharmacodynamics for 2-3 weeks with modest PDF cell expansion. In particular, γδ T cells are the highest fold expanding cell population; CD4+ and CD8+ naïve T cells are the lowest fold expanding cell population; and CD8+ stem cell memory cells are the highest expanding relevant population.

FIG. 106A-106E depicts the expansion of A) CD8+PD1+ T cells, B) CD8 stem cell memory, C) CD8 naive, D) γδ T cells, and E) CD56+ NK cells in cynomolgus monkeys following administration with either XENP30516 (mAb C_H1_L1.1×IL-15[D30N/E64Q/N65D]) or XENP30518 (αRSV×IL-15[D30N/E64Q/N65D]). Collectively, the data show that XENP30516 (having high PD-1 affinity and lower IL-15 potency) enabled sustained peripheral pharmacodynamics with no significant PD1− cell expansion. In particular, γδ T cells are the highest fold expanding cell population; CD4+ and CD8+ naïve T cells are the lowest fold expanding cell population; and CD8+ stem cell memory cells are the highest expanding relevant population.

Figure 107:
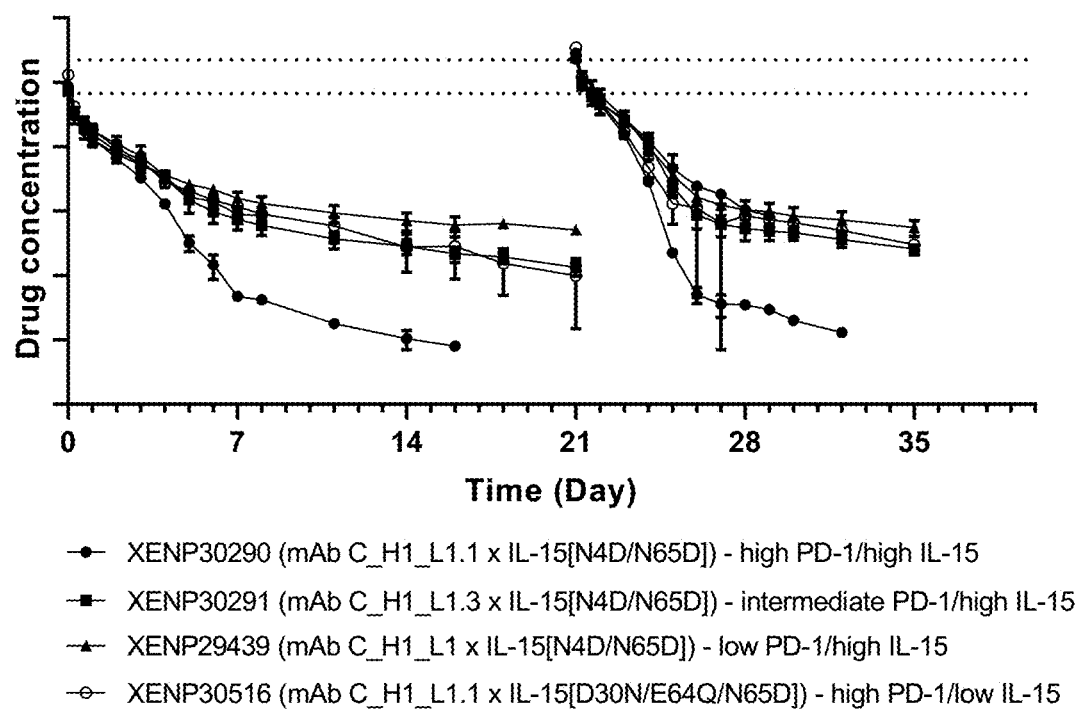

FIG. 107 depicts the change in serum concentration level over time in cynomolgus monkeys dosed with XENP30290, XENP30291, XENP29439, or XENP30516. The data show that XENP30290 which has the highest PD-1 affinity and higher IL-15 potency resulted in faster clearance than both XENP30291 and XENP29439 which have lower PD-1 affinity. However, XENP30516 which has the highest PD-1 affinity but lower IL-15 potency resulted in slower clearance than XENP30290.

Figure 108:
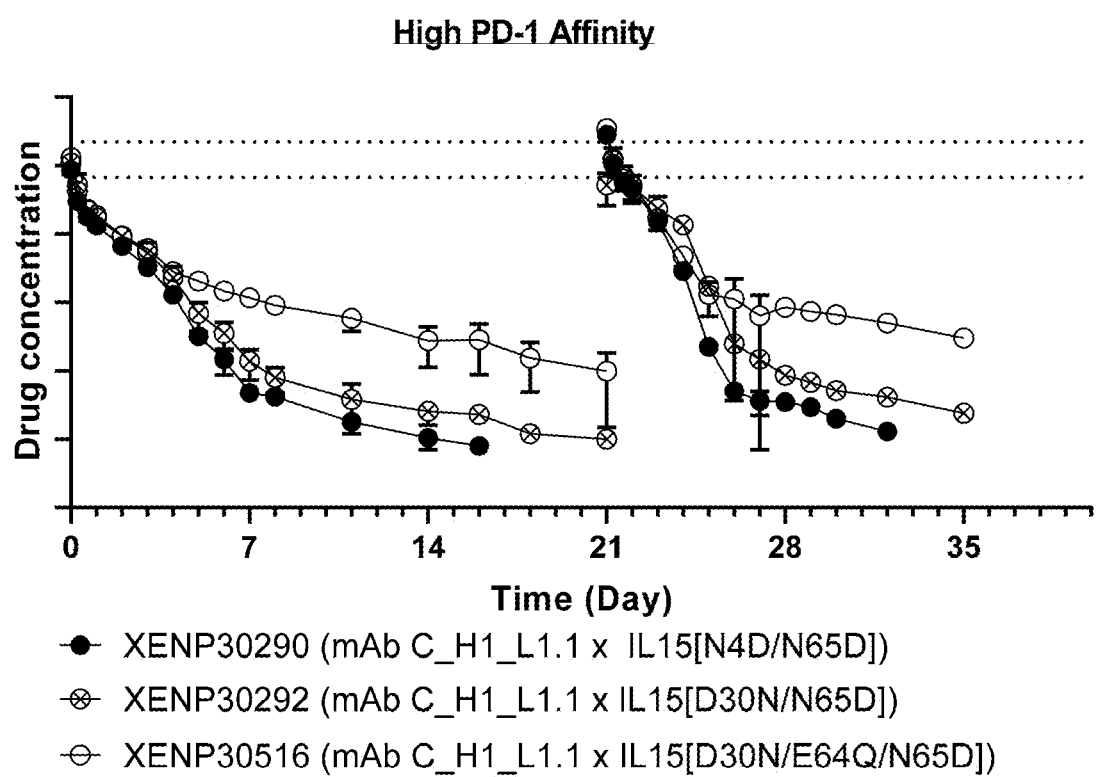

FIG. 108 depicts the change in serum concentration level over time in cynomolgus monkeys dosed with XENP30290, XENP30292, or XENP30516. The data show that XENP30516 which has the lower IL-15 potency resulted in slower clearance than XENP30290.

Figure 109:
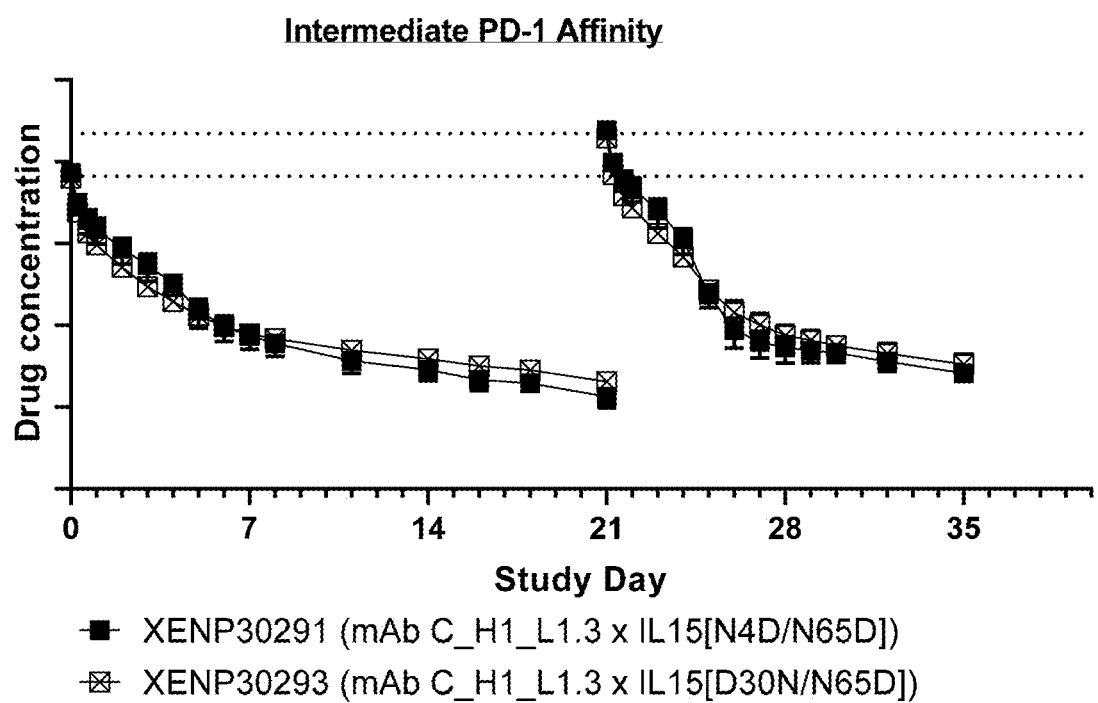

FIG. 109 depicts the change in serum concentration level over time in cynomolgus monkeys dosed with XENP30291 or XENP30293.

Figure 110:
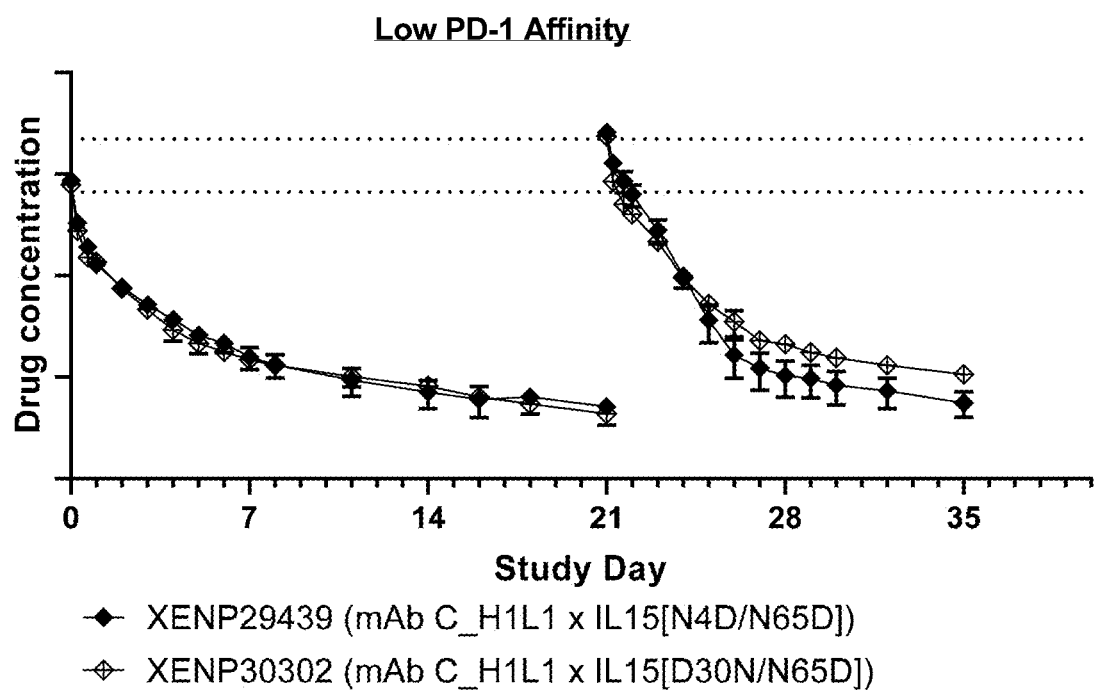

FIG. 110 depicts the change in serum concentration level over time in cynomolgus monkeys dosed with XENP29439 or XENP30302.

Figure 111:
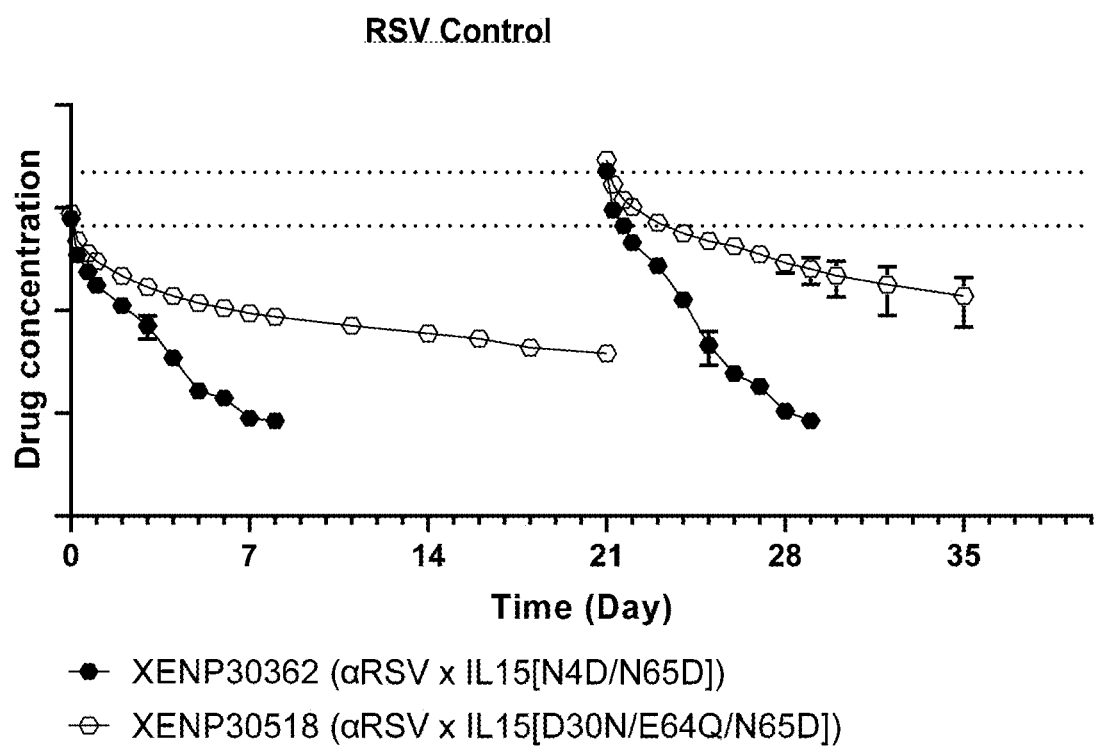

FIG. 111 depicts the change in serum concentration level over time in cynomolgus monkeys dosed with XENP30362 or XENP30518. The data show that higher IL-15 potency correlates with faster clearance.

Figure 112A:
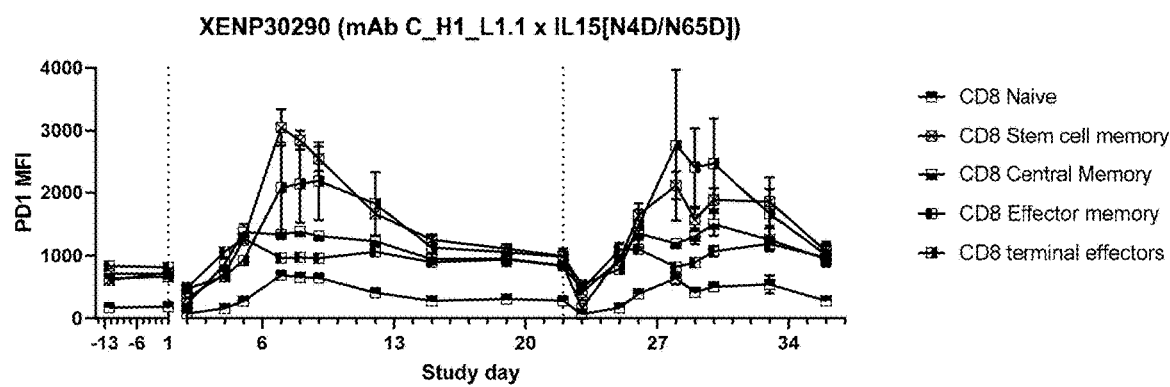
Figure 112B:
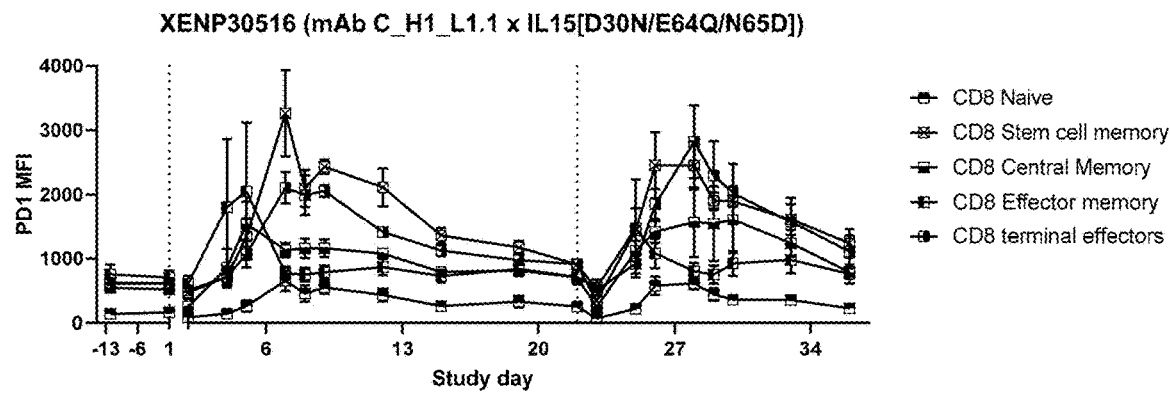
Figure 112C:
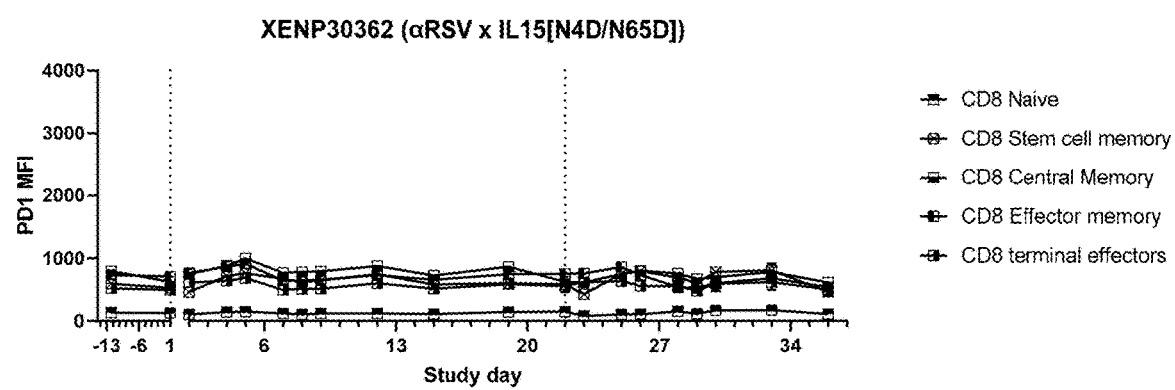

FIG. 112A-112C depicts change in PD-1 expression in various lymphocyte populations over time in cynomolgus monkeys dosed with A) XENP30290, B) XENP30516, or C) XENP30362. The data show that PD-1-targeted IL-15/Rα-Fc fusions increase PD-1 expression, while control RSV-targeted IL-15/Rα-Fc fusion does not.

Figure 113:
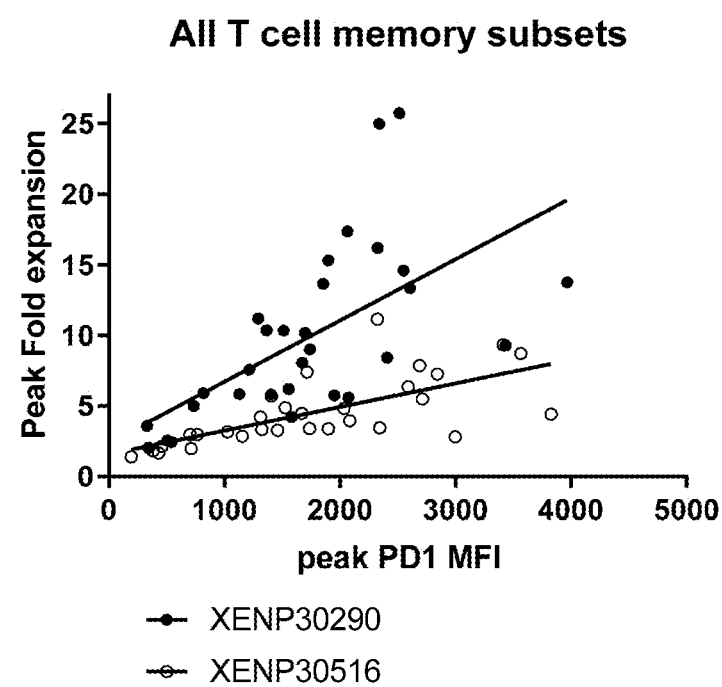
Figure 114A:
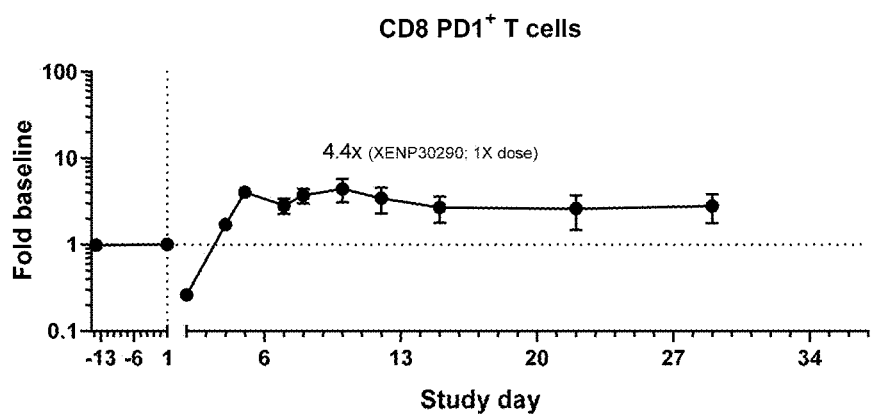
Figure 114B:
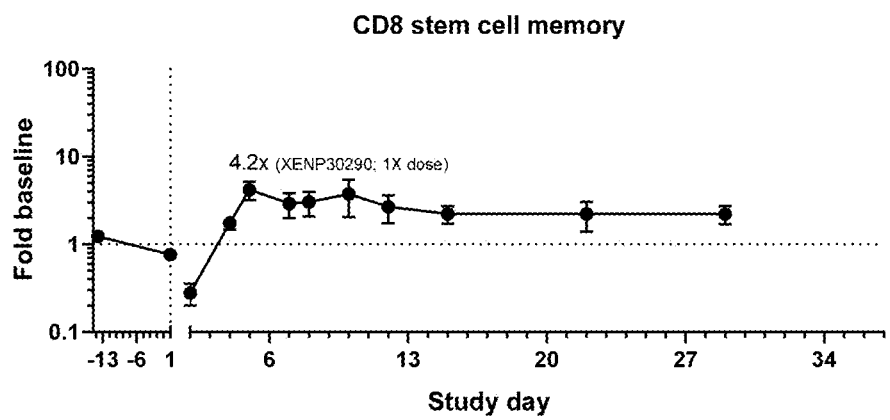
Figure 114C:
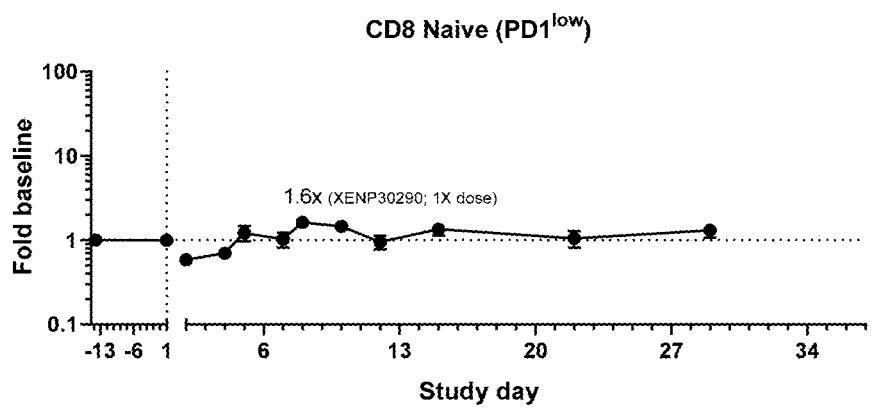
Figure 114D:
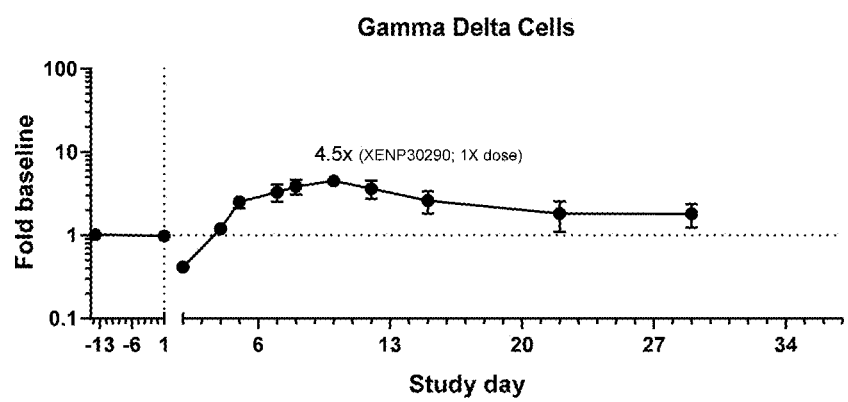
Figure 114E:
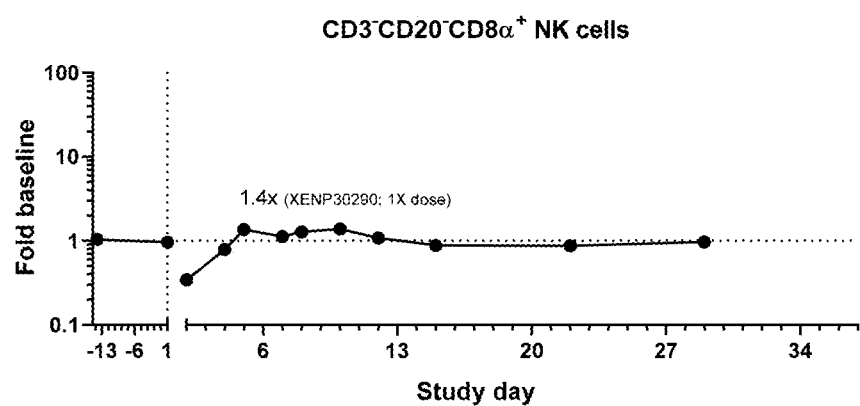

FIG. 113 depicts the correlation between peak fold expansion of all T cell memory subsets and peak PD-1 expression induced by XENP30290 or XENP30516.

FIG. 114A-114E depicts expansion of A) CD8+PD1+ T cells, B) CD8+ stem cell memory, C) CD8 naive (PD1$^{low}$), D) γδ cells, and E) NK cells in cynomolgus monkeys dosed with 1× low dose XENP30290 (PD1×IL15[N4D/N65D]). The data show that XENP30290 induced PD1+ cell expansion at 1× low dose.

Figure 115A:
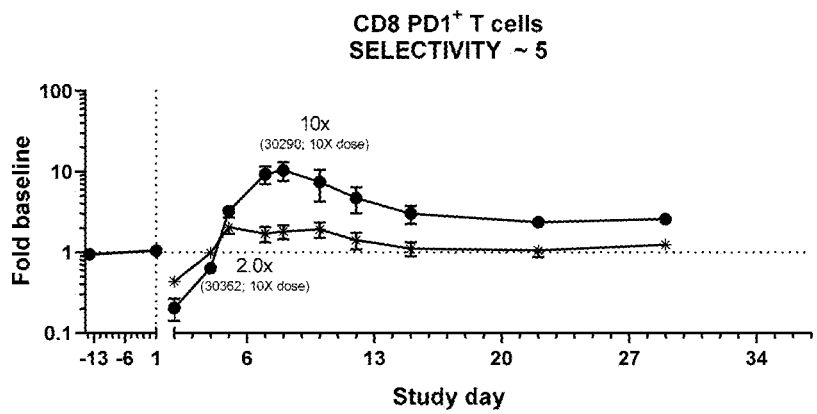
Figure 115B:
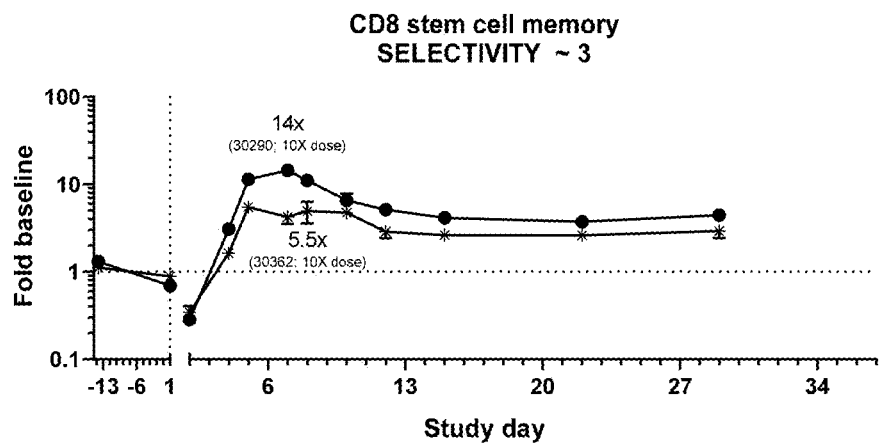
Figure 115C:
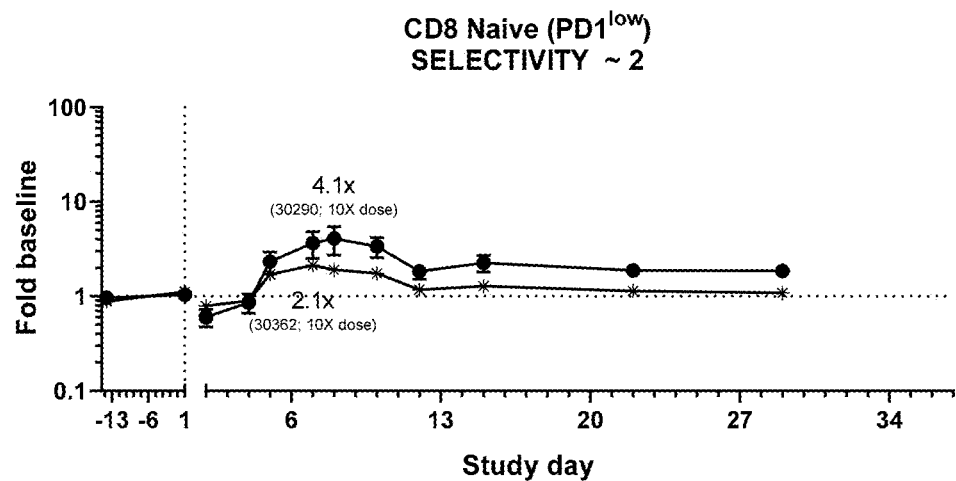
Figure 115D:
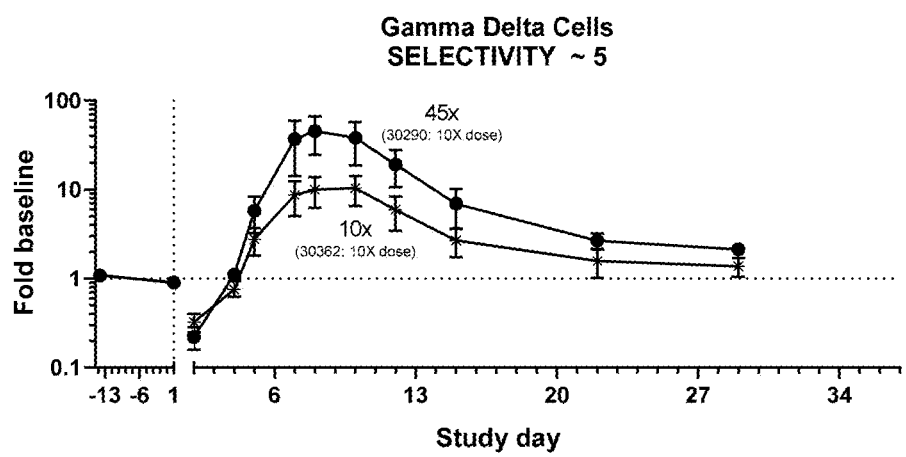
Figure 115E:
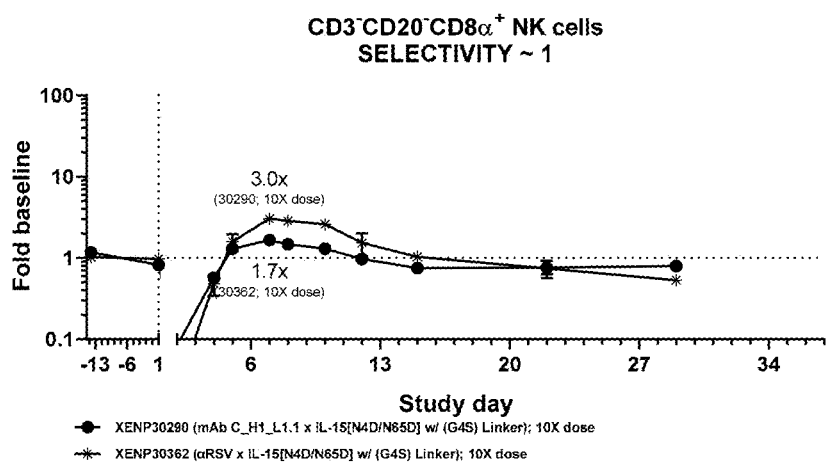
Figure 116A:
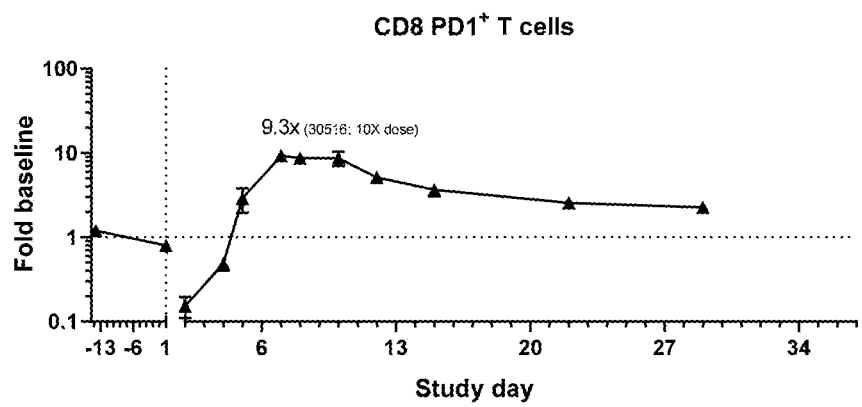
Figure 116B:
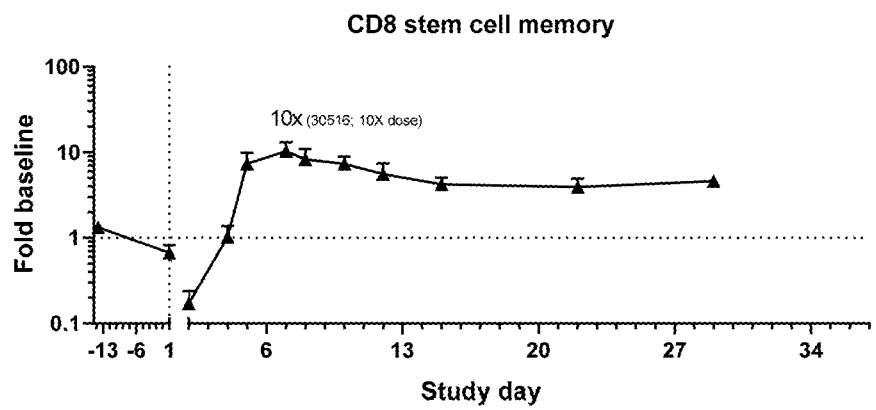
Figure 116C:
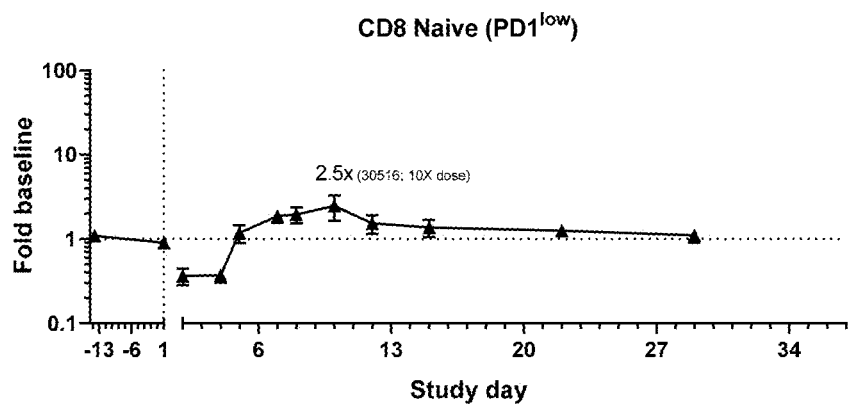
Figure 116D:
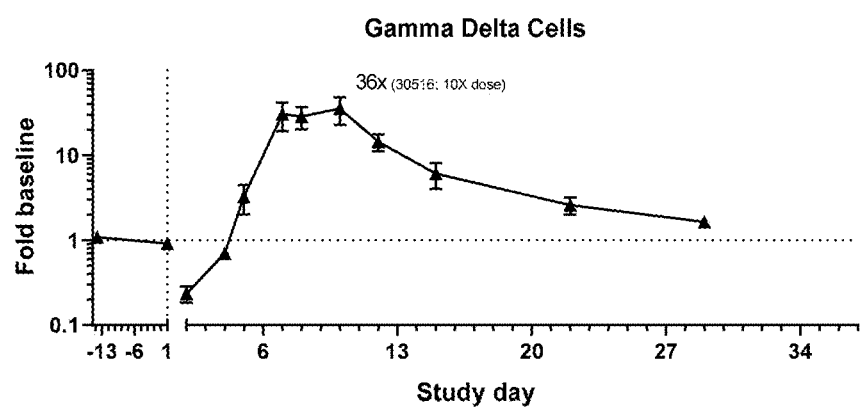
Figure 116E:
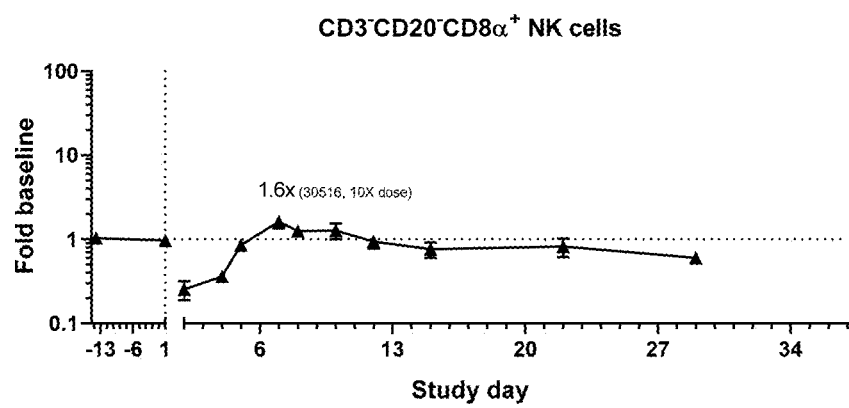

FIG. 115A-115E depicts expansion of A) CD8+PD1+ T cells, B) CD8+ stem cell memory, C) CD8 naive (PD1$^{low}$), D) γδ cells, and E) NK cells in cynomolgus monkeys dosed with 10× high dose XENP30290 (PD1×IL15[N4D/N65D]) and counterpart RSV-targeted surrogate XENP30362. The data show that XENP30290 induced good PD1+ cell expansion at 10× high dose but has moderate activity on PD1− cells as shown by the activity of RSV-targeted control XENP30362. FIG. 115E discloses "G4S" as SEQ ID NO: 10.

FIG. 116A-116E depicts expansion of A) CD8+PD1+ T cells, B) CD8+ stem cell memory, C) CD8 naive (PD1$^{low}$), D) γδ cells, and E) NK cells in cynomolgus monkeys dosed with 10× high dose XENP30516 (PD1×IL15[D30N/E64Q/N65D]). The data show that XENP30516 induced good PD1+ cell expansion at 10× high dose.

Figure 117A:
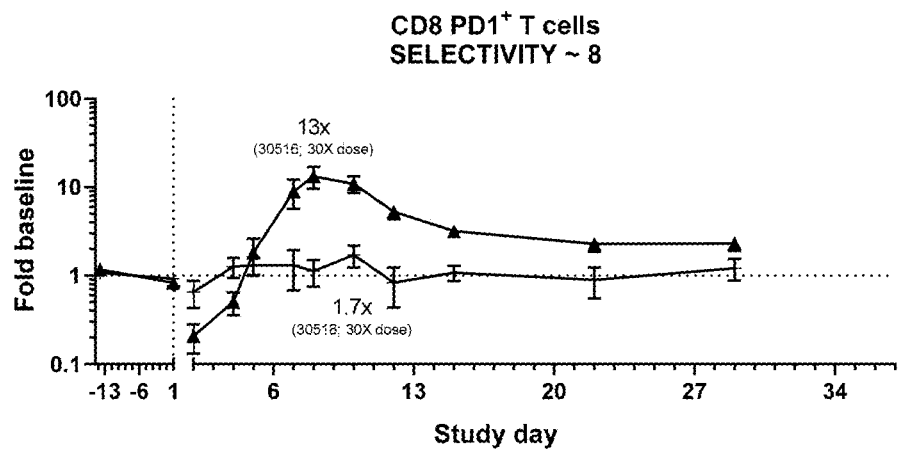
Figure 117B:
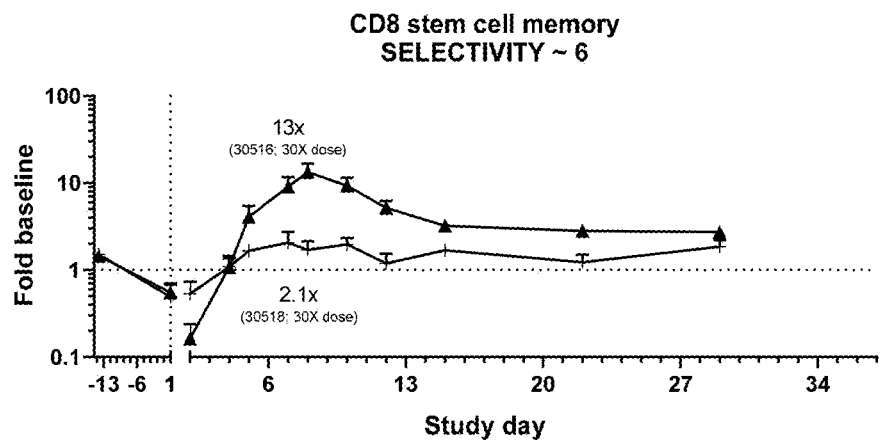
Figure 117C:
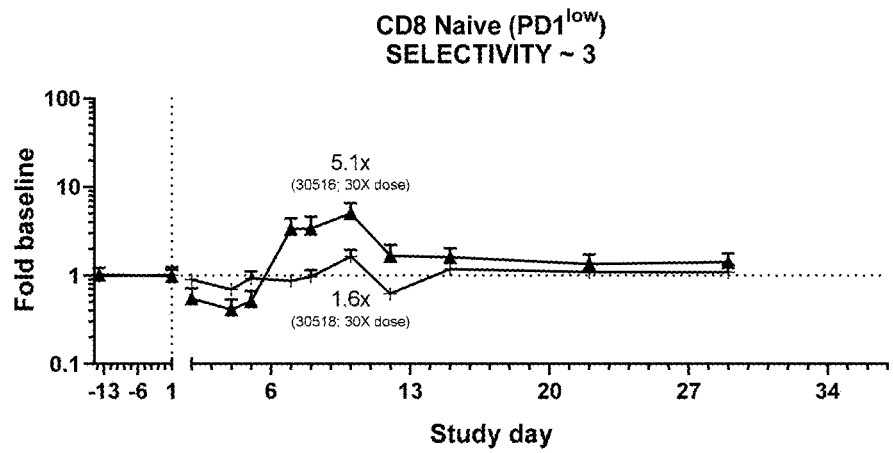
Figure 117D:
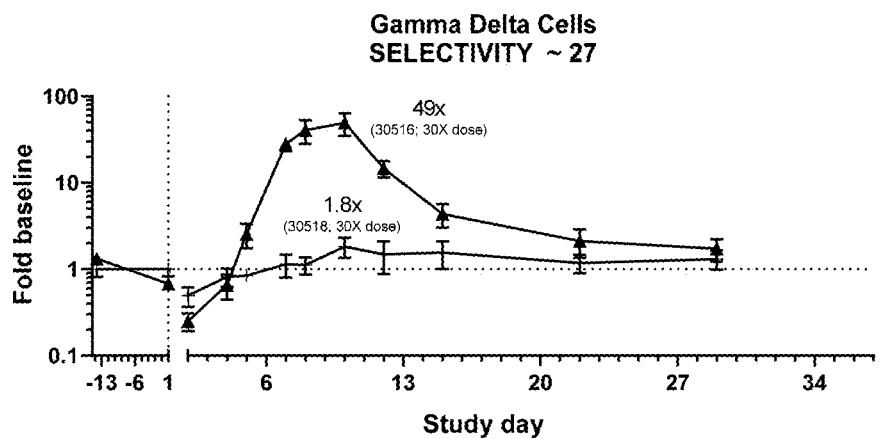
Figure 117E:
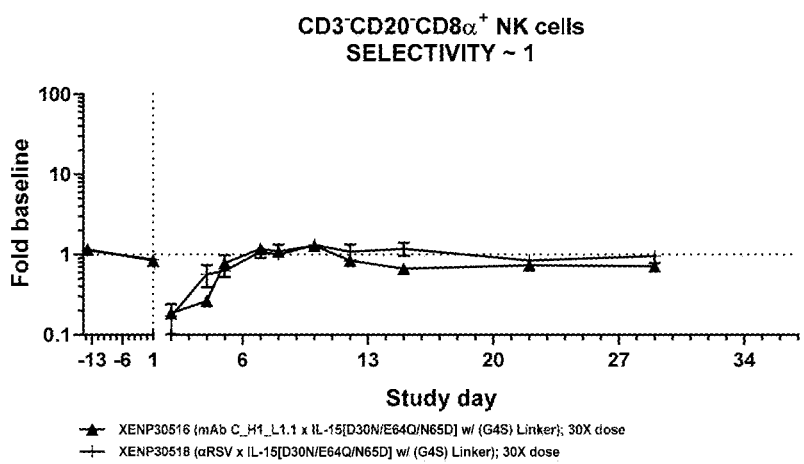

FIG. 117A-117E depicts expansion of A) CD8+PD1+ T cells, B) CD8+ stem cell memory, C) CD8 naive (PD1$^{low}$), D) γδ cells, and E) NK cells in cynomolgus monkeys dosed with 30× very high dose XENP30516 (PD1×IL15[D30N/E64Q/N65D]) and counterpart RSV-targeted surrogate XENP30518. The data show that XENP30516 induced greater PD1+ expansion at 30× very high dose while maintaining excellent selectivity. FIG. 117E discloses "G4S" as SEQ ID NO: 10.

Figure 118:
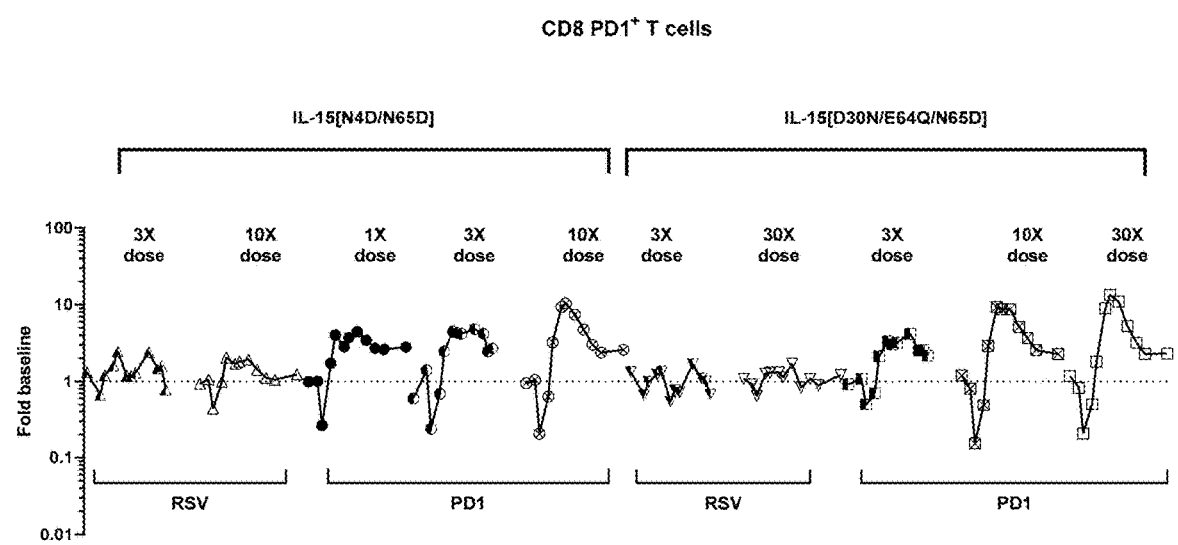
Figure 119A:
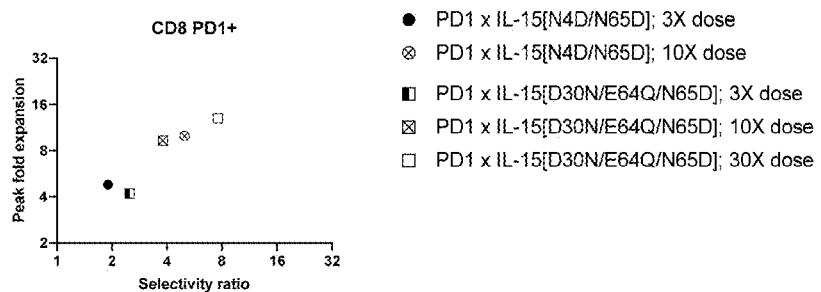
Figure 119B:
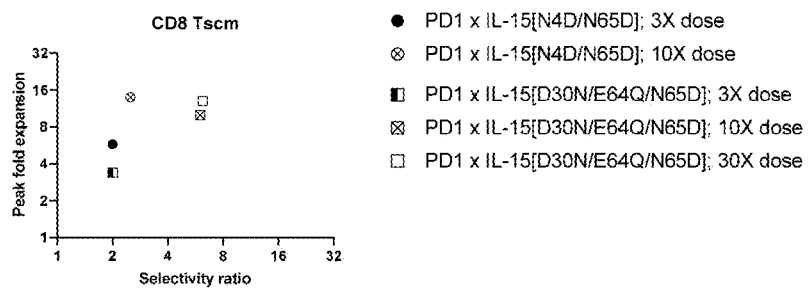
Figure 119C:
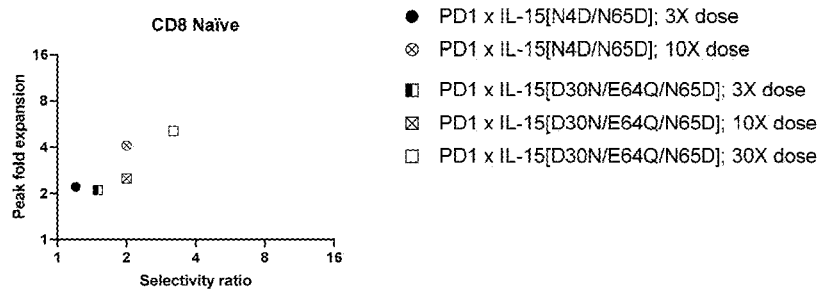
Figure 119D:
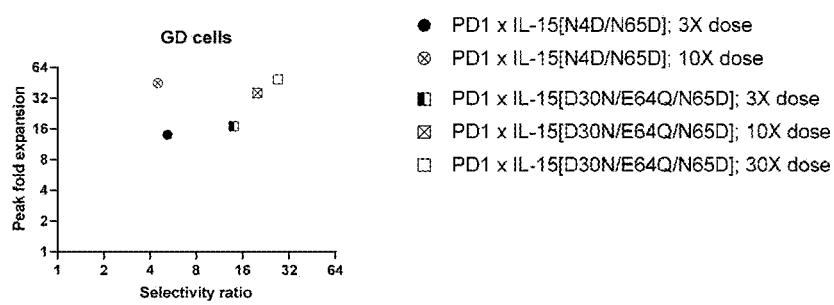
Figure 119E:
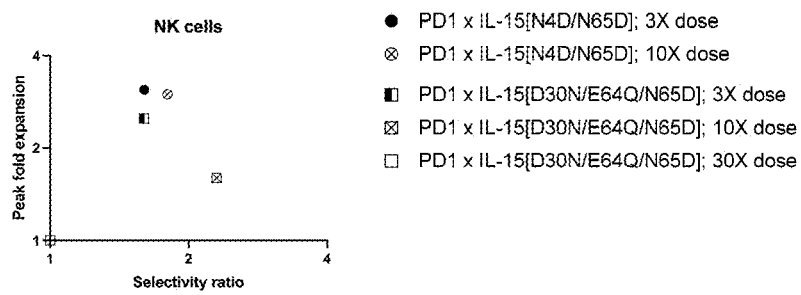

FIG. 118 summarizes expansion of CD8+PD1+ T cells in cynomolgus monkeys dosed with various concentrations of various PD-1-targeted or RSV-targeted IL-15/Rα-Fc fusions comprising either IL-15[N4D/N65D] or IL-15[D30N/E64Q/N65D].

FIG. 119A-119E depicts the correlation between selectivity ration and peak fold expansion of A) CD8+PD1+ T cells, B) CD8+ stem cell memory, C) CD8 naive (PD1$^{low}$), D) γδ cells, and E) NK cells in cynomolgus monkeys dosed with various concentrations of various PD-1-targeted or RSV-targeted IL-15/Rα-Fc fusions comprising either IL-15[N4D/N65D] or IL-15[D30N/E64Q/N65D]. Collectively, the data show that increasing dose results in higher selectivity.

FIG. 120 depicts sequences of XENP20818 (WT IL-15), XENP22821 (IL-15[N65D]), and XENP24045 (IL-15[D30N/E64Q/N65D]) which are illustrative IL-15/Rα-Fc fusion proteins of the "IL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 7), and slashes (/) indicate the border(s) between IL-15, IL-15Rα, linkers, and Fc regions.

Figure 121:
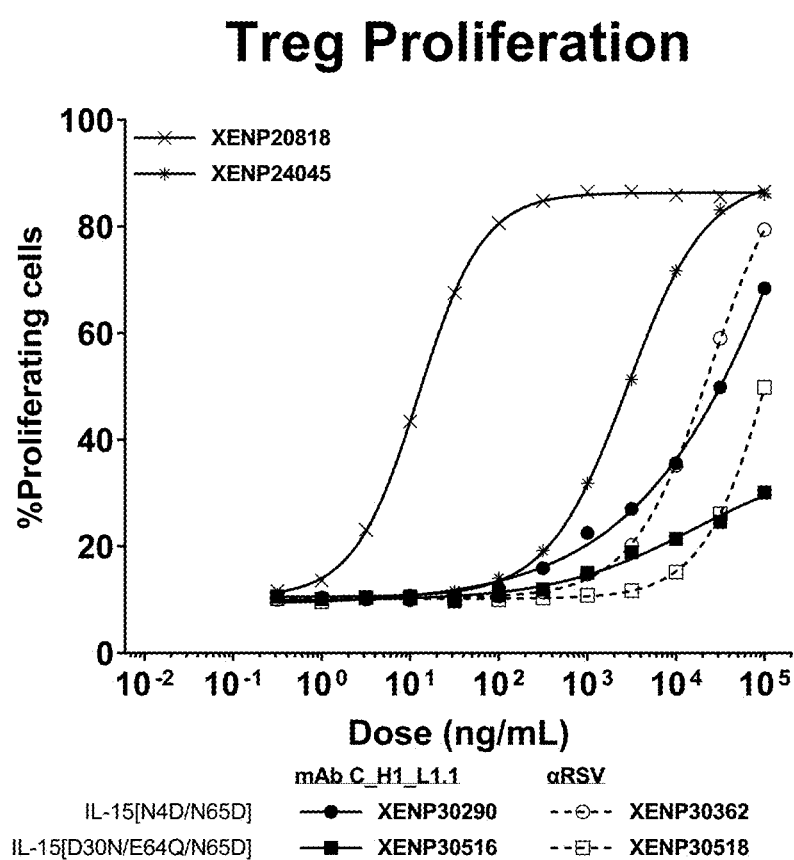

FIG. 121 depicts proliferation of rapamycin expanded Tregs following treatment with untargeted IL-15/Rα-Fc fusions XENP20818 and XENP24045 as well as various PD-1-targeted or control RSV-targeted IL-15/Rα-Fc fusions. The data show that IL-15/Rα-Fc fusions (targeted and untargeted) do induce proliferation of the rapamycin-expanded Tregs (as measured by Tag-it Violet dilution). Notably, the PD-1-targeted IL-15/Rα-Fc fusions were much less potent in inducing proliferation of Tregs in comparison to untargeted IL-15/Rα-Fc fusions.

Figure 122A:
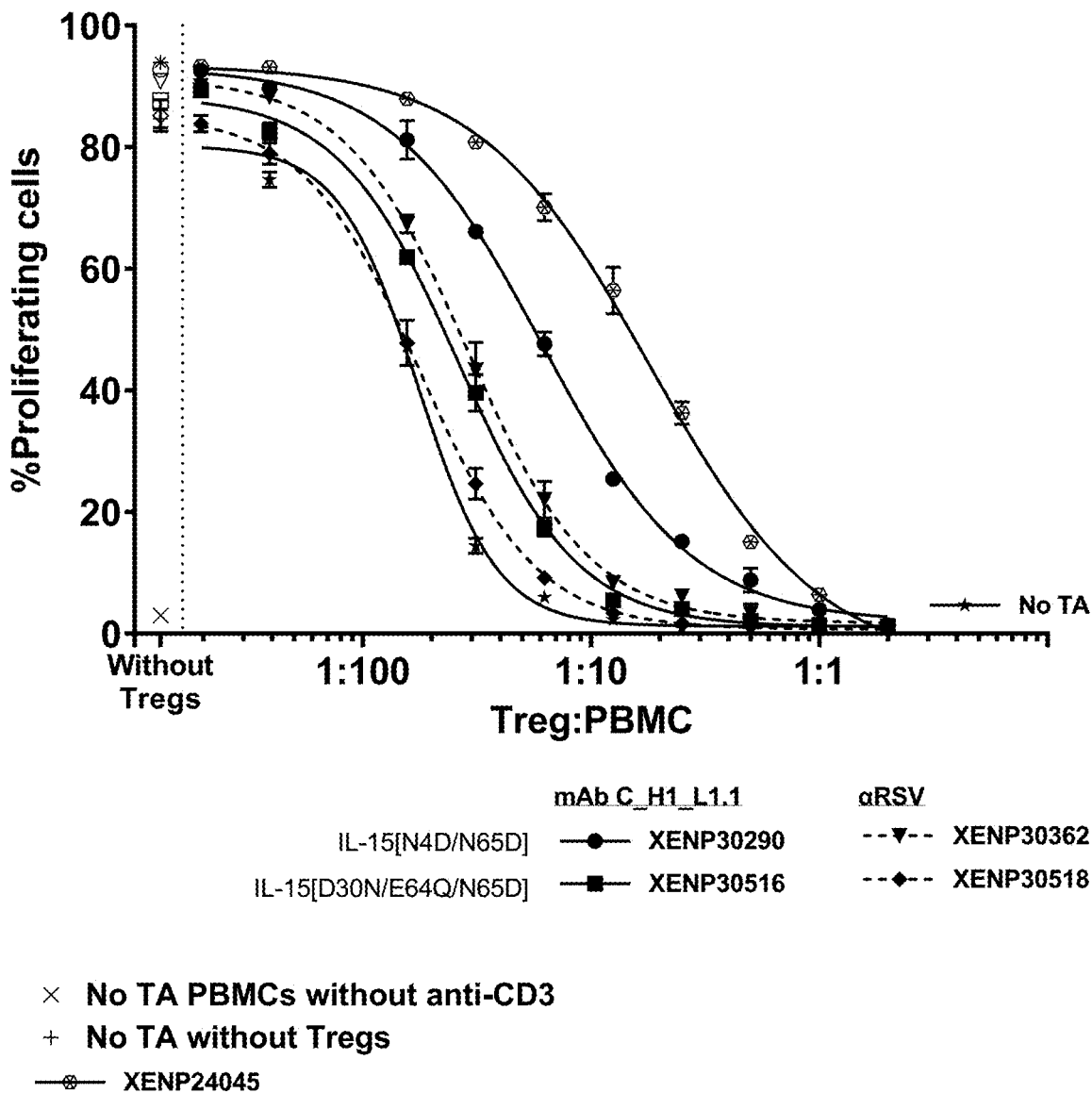

FIG. 122A-112B depicts the proliferation of A) CD8 effector memory T cells and B) CD4 effector memory T cells (as determined by CFSE dilution) following incubation of 1×10$^5$ CFSE-labeled PBMCs with 5 μg/ml of the indicated test articles and increasing number of rapamycin-expanded Tregs. The data show that the PD-1-targeted IL-15/Rα-Fc fusions shifted (reduced) the potency of Treg-induced suppression of CD8 and CD4 effector memory T cell proliferation. Notably, the shift by control RSV-targeted IL-15/Rα-Fc fusions was less than the reduction in potency induced by the PD-1-targeted IL-15/Rα-Fc fusions.

Figure 123A:
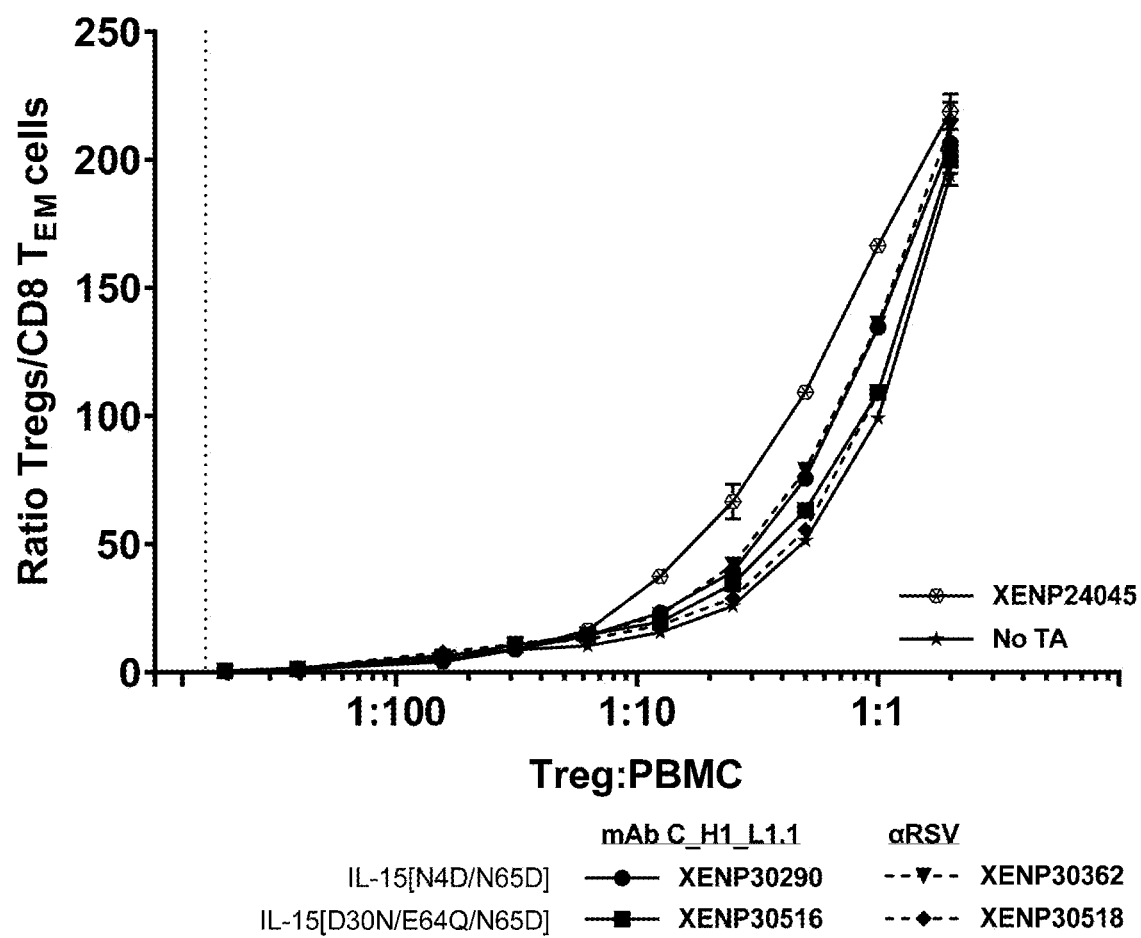
Figure 123B:
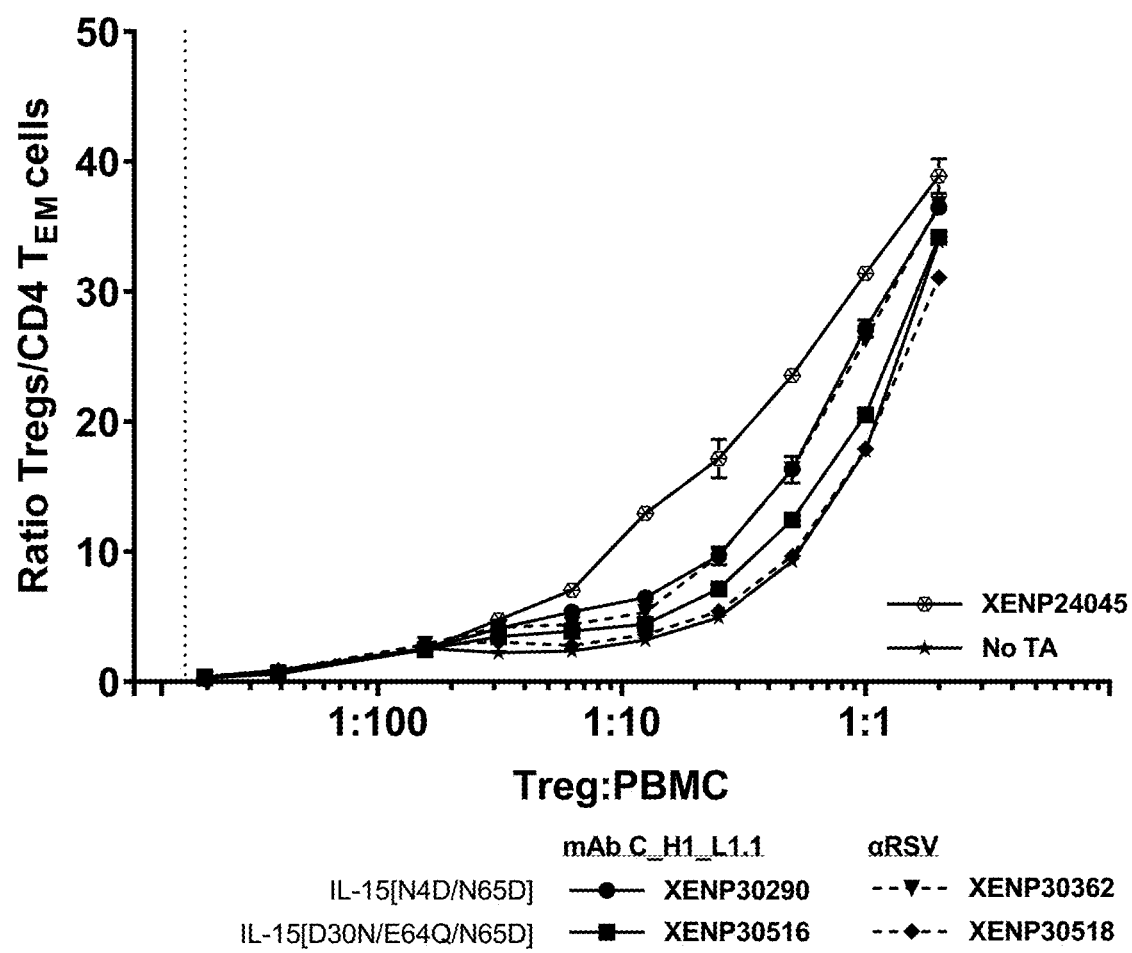

FIG. 123A-123B depicts the ratio of A) Treg to CD8 effector memory T cells and B) Treg to CD4 effector memory T cells following incubation of 1×10$^5$ CFSE-labeled PBMCs with 5 μg/ml of the indicated test articles and increasing number of rapamycin-expanded Tregs. The data show that in comparison to no test articles, the PD-1-targeted IL-15/Rα-Fc fusions increased the Treg/T$_{EM}$ ratio, and yet T$_{EM}$ cell proliferation is enhanced by the PD-1-targeted IL-15/Rα-Fc fusions. This indicates that although Tregs are expanded, the expanded Tregs demonstrate decreased suppressive capacity.

Figure 124A:
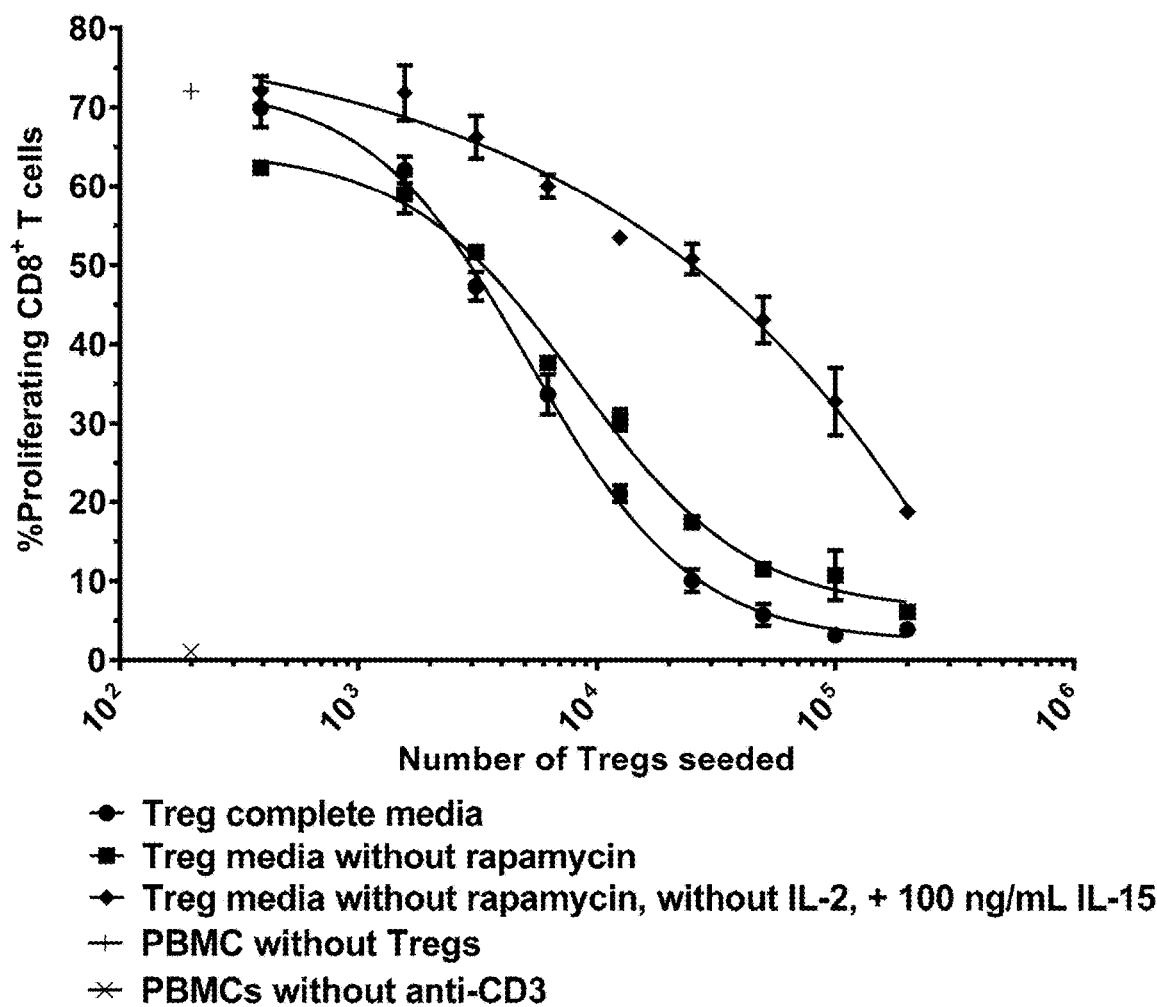
Figure 124B:
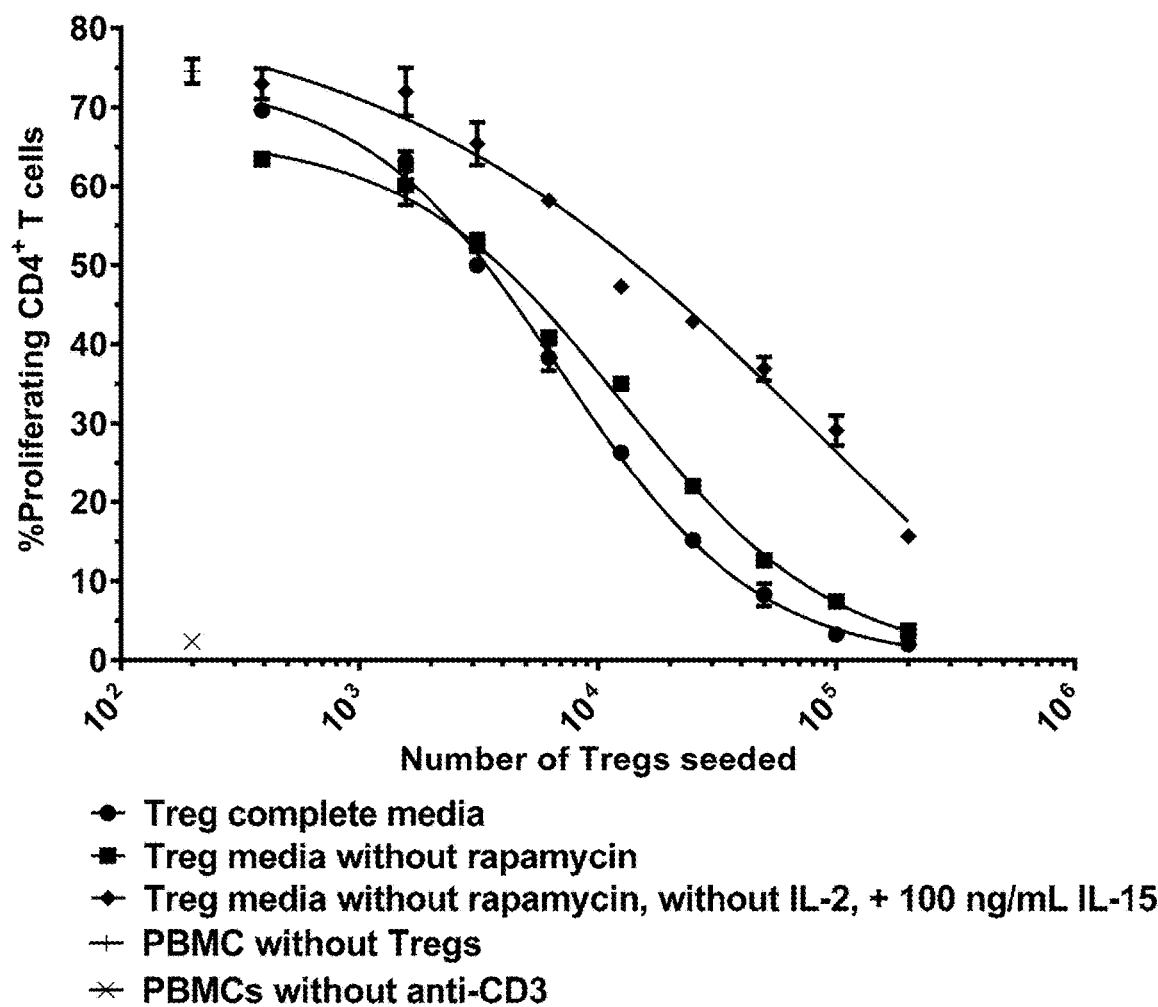

FIG. 124A-124B depicts percentage proliferating A) CD8+ T cells and B) CD4+ T cells (as determined by CFSE dilution) following incubation CD3-stimulated PBMCs with rapamycin expanded Tregs pre-cultured for 6 days with complete Treg media (RPMI with 10% FBS, 0.5 μg/ml anti-CD28, 100 U/ml IL-2, 100 ng/ml rapamycin); complete Treg media without rapamycin; or with 100 ng/ml IL-15 (in RPMI with 10% FBS, 0.5 μg/ml anti-CD28; no IL-2; no rapamycin). The data show that Tregs pre-treated with IL-15 show impaired suppressive capacity.

Figure 125A:
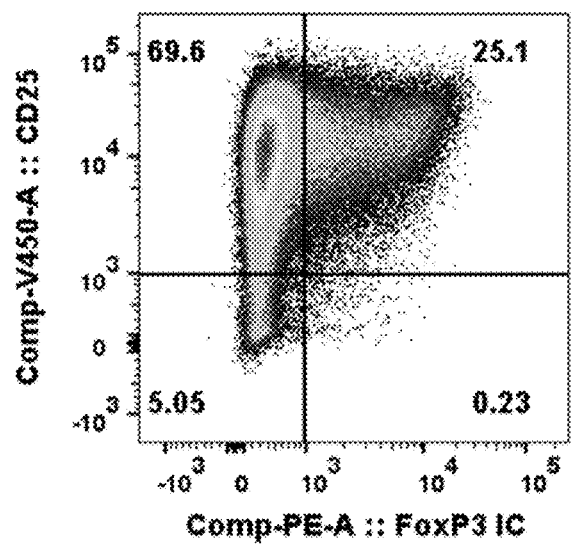
Figure 125B:
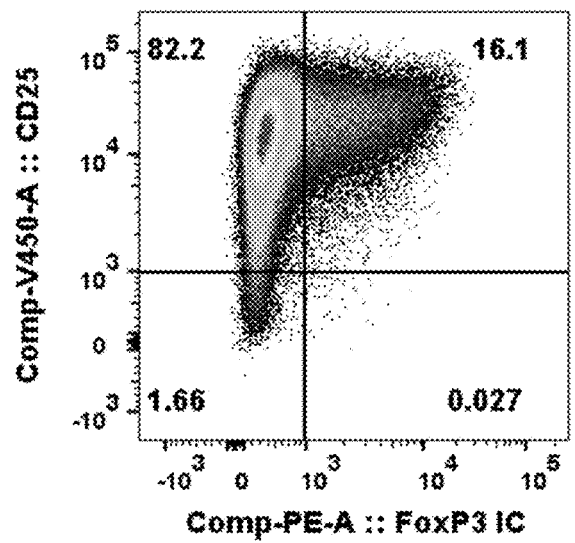

FIG. 125A-125B depicts expression of CD25 and FOXP3 on CD4+ T cells in PBMCs treated A) without or B) with 5 μg/ml IL-15/Rα-Fc fusion XENP22821 for 14 days. The data show that treatment with XENP22821 reduced FOXP3 expression on the CD4+ T cell population.

Figure 126A:
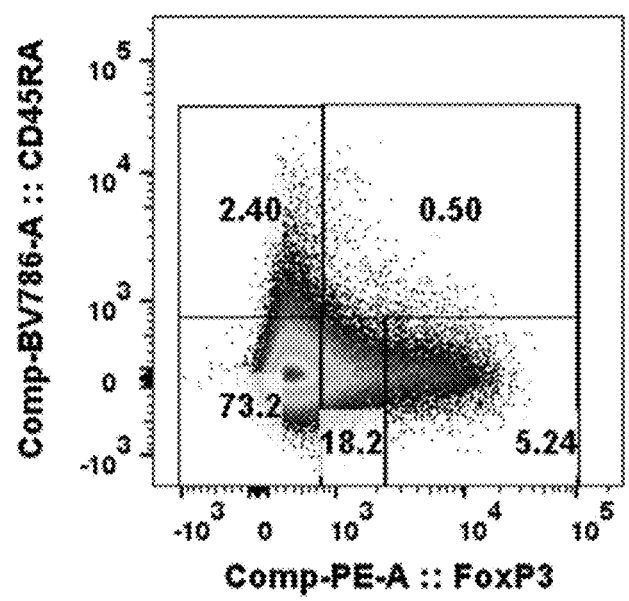
Figure 126B:
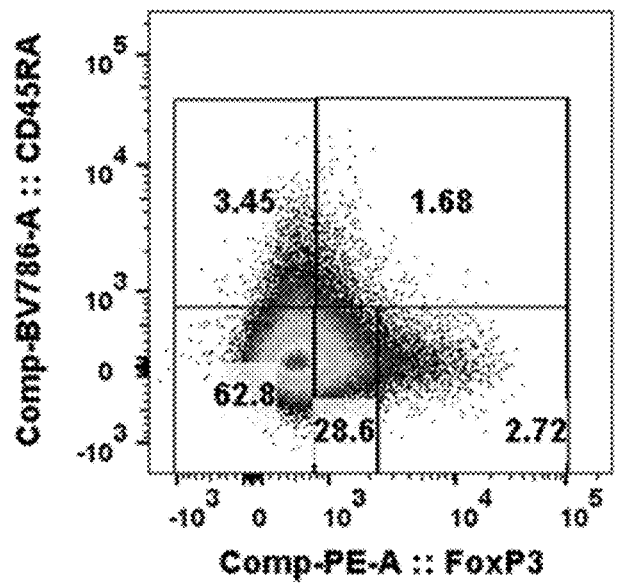

FIG. 126A-126B depicts expression of CD45RA and FOXP3 on CD4+ T cells in PBMCs treated A) without or B) with 5 μg·ml IL-15/Rα-Fc fusion XENP22821 for 14 days. The data show that treatment with XENP22821 shifts CD4+ CD45RA− populations from FoxP3$^{high}$ to FoxP3$^{low}$, indicating that treatment with IL-15/Rα-Fc fusions actually shifted population from eTreg (decreased population from 5.24% to 2.72%) to activated effector CD4 T cells (increased population from 18.2% to 28.6%).

Figure 127A:
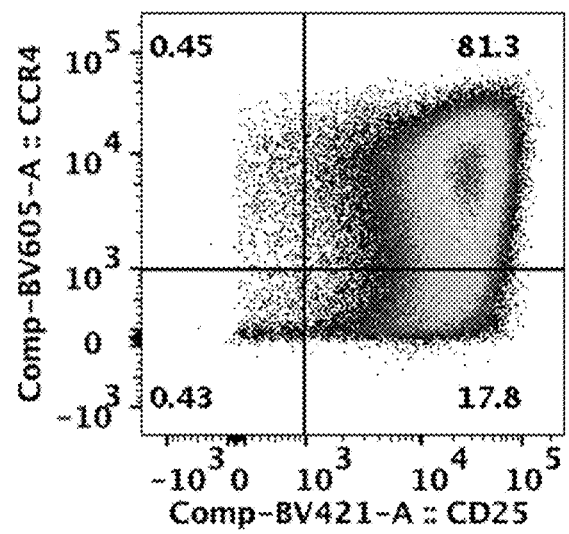
Figure 127B:
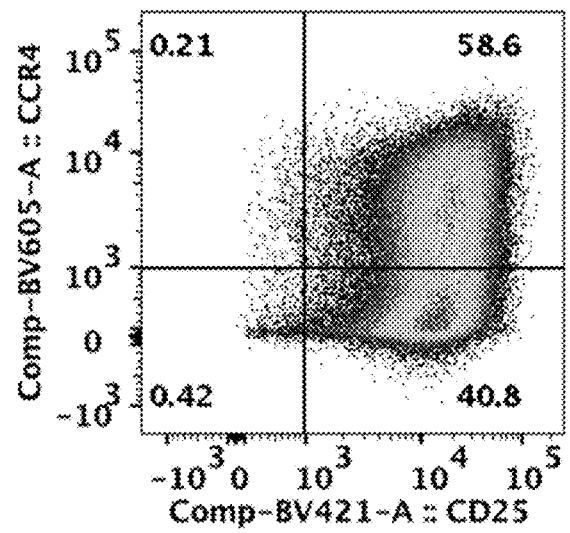

FIG. 127A-127B depicts expression of CD25 and CCR4 on CD4+ T cells in PBMCs treated A) without or B) with 5 μg/ml IL-15/Rα-Fc fusion XENP22821 for 14 days. The data show that treatment with XENP22821 reduced CCR4 expression on the CD4+ T cell population.

Figure 128A:
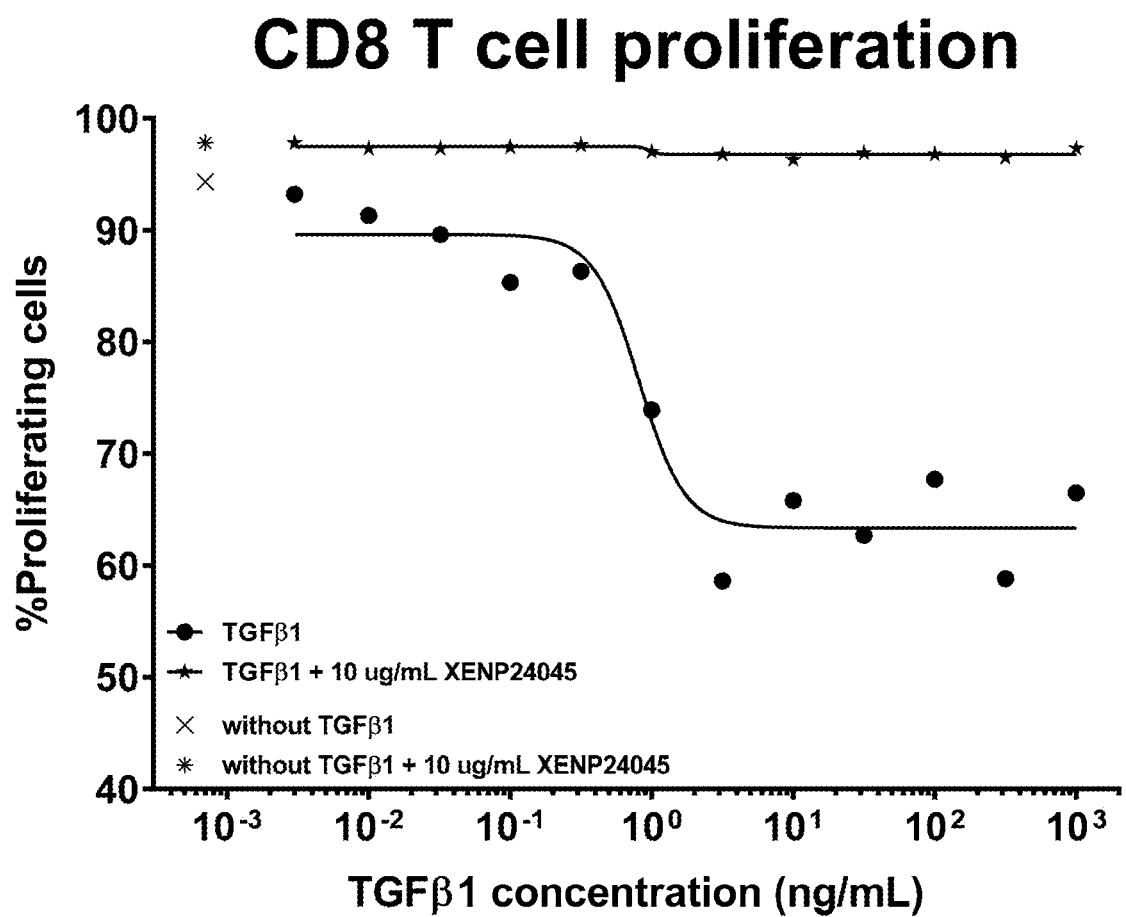
Figure 128B:
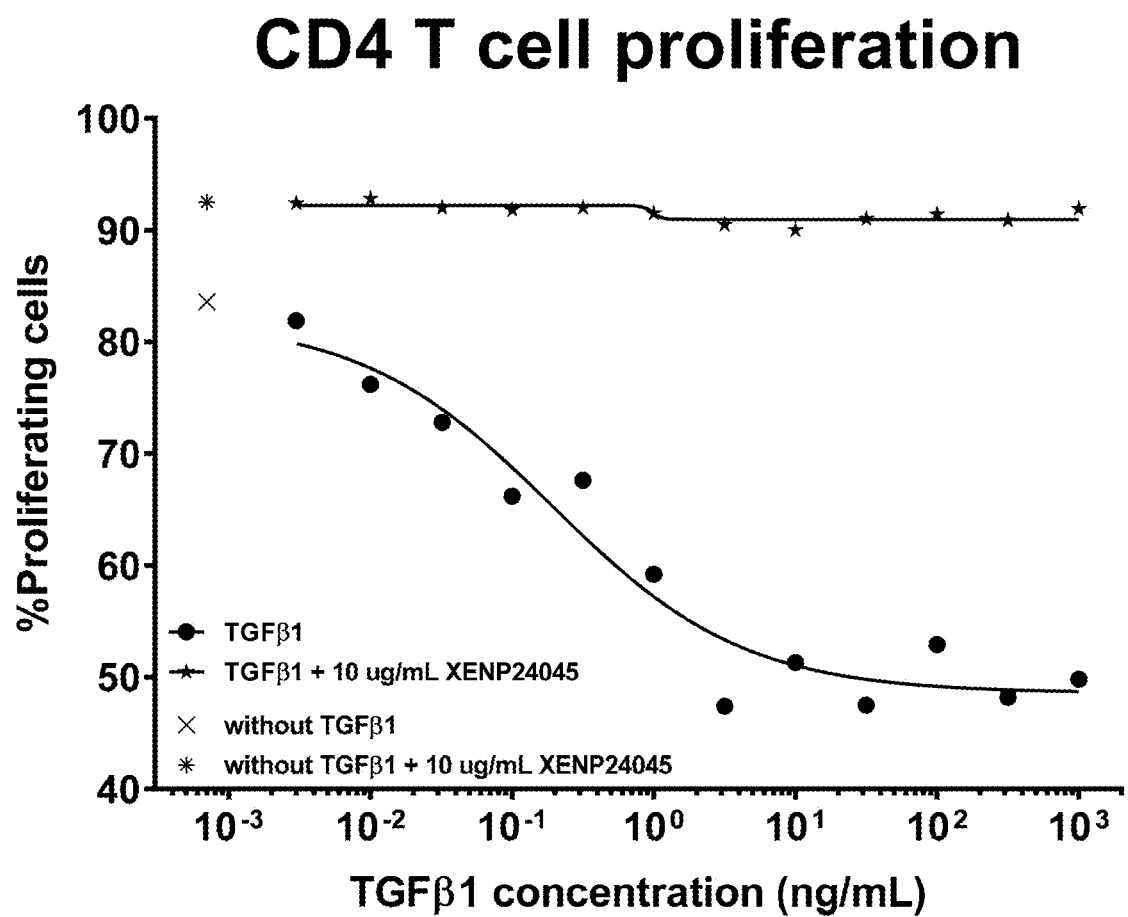

FIG. 128A-128B depicts proliferation of A) CD8 T cells and B) CD4 T cells (as determined by CFSE dilution) following incubation of CFSE-labeled PBMCs on 100 ng/ml plate-bound anti-CD3 (OKT3) with 10 μg/ml of IL-15/Rα-Fc fusion XENP24045 and indicated concentration of TGFβ1. The data shows that TGFβ dose-dependently suppresses proliferation of T cells; however, notably, IL-15/Rα-Fc fusion prevents TGFβ suppression of T cell proliferation at all doses tested.

DETAILED DESCRIPTION OF THE INVENTION

I. Nomenclature

The heterodimeric fusion proteins of the invention are listed in several different formats. Each polypeptide is given a unique "XENP" number, although as will be appreciated in the art, a longer sequence might contain a shorter one. For example, the heavy chain of a monomer comprising the Fab for anti-PD-1 (see FIG. 28C, for example) will have a first XENP number, while the VH and VL domains can have a different XENP number. Some molecules have three polypeptides, so the XENP number, with the components, is used as a name. Thus, the molecule XENP29484, which is in "scIL-15/Rα× Fab" comprises three sequences, generally referred to as "XENP29484-chain 1", XENP29484 chain 2" and "XENP29484 chain 3" or equivalents, although one of skill in the art would be able to identify these easily through sequence alignment. These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs; note that all molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of Fab side of XENP30486 (which binds PD-1) is "H1.132", which indicates that the variable heavy domain H1.132 was used, and in XENP30486, it was combined with the light domain L1.135. Thus, the designation "mAbC[PD-1]_H1.132_L1.135", indicates that the variable heavy domain H1.132 was combined with the light domain L1.135. In the case where these sequences are combined into an scFv, this designation shows that the scFv is in VH-linker-VL orientation, from N- to C-terminus. This molecule with the identical sequences of the heavy and light variable domains but in the reverse order would be named "mAbC[PD-1]_L1.135_H1.132". Similarly, different constructs may "mix and match" the heavy and light chains as will be evident from the sequence listing and the Figures.

II. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with more than 70-80-90-95-98% loss of activity being preferred, and in general, with the activity being below the level of detectable binding in a Biacore assay. Of particular use in the ablation of FcγR binding are those shown in FIG. 6. However, unless otherwise noted, the Fc monomers of the invention retain binding to the FcRn receptor.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "PD-1 antigen binding domain" binds a human PD-1 antigen as outlined herein (and in many cases will also bind to cynomolous monkey PD-1). As is known in the art, these CDRs are generally present as a first set of variable heavy CDRs (vhCDRs or $V_H$CDRs) and a second set of variable light CDRs (vlCDRs or $V_L$CDR5), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the VH and VL domains are covalently attached, generally through the use of a linker as outlined herein, into a single polypeptide sequence, which can be either (starting from the N-terminus) vh-linker-vl or vl-linker-vh.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g. vlCDR1, vlCDR2 and vlCDR3).

A useful comparison of CDR numbering is as below, see Lafranc et al., Dev. Comp. Immunol. 27(1):55-77 (2003):

TABLE 1

|  | Kabat Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains (or, in the case of the NC[PD-1] Fvs, the anti-PD-1 CDRs of the present invention do not compete for binding to the same epitope as enumerated antibodies.

In terms of antibodies, components of which are used in the present invention, the carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 231-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some embodiments, for example in the context of an Fc region, the lower hinge is included, with the start of the "lower hinge" generally referring to position 226. As noted herein, pI variants can be made in the hinge region as well.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 2

|  | EU Numbering | Kabat Numbering |
| --- | --- | --- |
| CH1 | 118-215 | 114-223 |
| Hinge | 216-230 | 226-243 |
| CH2 | 231-340 | 244-360 |
| CH3 | 341-447 | 361-478 |

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined herein, is the Fc region.

Thus, the present invention provides different protein domains. As described herein and known in the art, the heterodimeric fusion proteins of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

By "Fc" or "Fc region" or "Fc domain" as used herein is meant the polypeptide comprising the constant region of an antibody excluding the first constant region immunoglobulin domain (e.g., CH1) and in some cases, part of the hinge. For IgG, the Fc domain comprises immunoglobulin domains CH2 and CH3 (Cγ2 and Cγ3) and the hinge region between CH1 (Cγ1) and CH2 (Cγ2). Although the boundaries of the Fc region may vary, the human IgG heavy chain Fc region is usually defined to include residues C226 or P230 to its carboxyl-terminus, wherein the numbering is according to the EU index as in Kabat. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. Thus, the "Fc domain" includes the —CH2-CH3 domain, and optionally a hinge domain (hinge-CH2-CH3. In some embodiments, as is more fully described below, amino acid modifications are made to the Fc region, for example to alter binding to one or more FcγR receptors or to the FcRn receptor, and to enable heterodimer formation and purification, as outlined herein.

Thus, the "Fc domain" includes the —CH2-CH3 domain, and optionally a hinge domain, which in many instances serves as a domain linker. In the embodiments herein, when a scFv is attached to an Fc domain, it is the C-terminus of the scFv construct that is attached to all or part of the hinge of the Fc domain; for example, it is generally attached to the sequence EPKS (SEQ ID NO: 7) which is the beginning of the hinge. Similarly, when an IL-15 component (whether an IL-15 complex, an IL-15 domain, or an IL-15Rα domain) is attached to an Fc domain, it is generally similarly attached to all or part of the hinge of the Fc domain (as a domain linker); for example, it is generally attached to the sequence EPKS (SEQ ID NO: 7) which is the beginning of the hinge.

The present invention is directed to Fc domains that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356E/358M allotype, however the other allotype is included herein. That is, any sequence inclusive of an IgG1 Fc domain included herein can have 356D/358L replacing the 356E/358M allotype.

In addition, many of the sequences herein have at least one the cysteines at position 220 replaced by a serine; generally this is the on the "scFv monomer" side or "IL-15 component" side for most of the sequences depicted herein, although it can also be on the "Fab monomer" side, or both, to reduce disulfide formation. Specifically included within the sequences herein are one or both of these cysteines replaced (C220S).

By "heavy chain" or "heavy chain domain" herein is meant, from N- to C-terminal, the VH-CH1-hinge-CH2-CH3 domains (wherein the CH2-CH3 comprises an Fc domain). The heavy chain comprises a variable heavy domain and a constant domain, which includes a CH1-optional hinge-Fc domain comprising a CH2-CH3. The light chain comprises a variable light chain and the light constant domain (VL-CL).

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y or 272Y refer to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, -233E designates an insertion of glutamic acid after position 233 and before position 234. Additionally, -233ADE or A233ADE designates an insertion of AlaAspGlu after position 233 and before position 234.

By "amino acid deletion" or "deletion" as used herein is meant the removal of an amino acid residue or sequence at a particular position in a parent polypeptide sequence. For example, E233-, E233 #, E233( ), E233_, or E233del designates a deletion of glutamic acid at position 233. Additionally, EDA233- or EDA233 # designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino acid sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it.

Accordingly, by "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, M428L/N434S is the same Fc variant as N434S/M428L and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004/0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein.

By "Fv" or "Fv fragment" or "Fv region" as used herein is meant a polypeptide that comprises the VL and VH domains of a single antibody and form an ABD. As will be appreciated by those in the art, these generally are made up of two chains, or can be combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N- to C-terminus (vh-linker-vl or vl-linker-vh).

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses.

By "variable region" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively. With reference to the variable heavy and light domains of the invention, the amino-terminal portion of each heavy and light antibody chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three CDRs and four framework regions (FRs), arranged from amino-terminus to carboxy-terminus in the following order: FR1-CDR1-FR2-CDR2-FR3-CDR3-FR4. Thus the variable heavy domain comprises VHFR1-VHCDR1-VHFR2-VHCDR2-VHFR3-VHCDR3-VHFR4 and the variable light domain comprises VLFR1-VLCDR1-VLFR2-VLCDR2-VLFR3-VLCDR3-VLFR4.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes.

By "FcRn" or "neonatal Fc Receptor" as used herein is meant a protein that binds the IgG antibody Fc region and is encoded at least in part by an FcRn gene. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants can be used to increase binding to the FcRn receptor, and in some cases, to increase serum half-life. In general, unless otherwise noted, the Fc monomers of the invention retain binding to the FcRn receptor (and, as noted below, can include amino acid variants to increase binding to the FcRn receptor).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it.

By "heavy constant region" herein is meant the CH1-hinge-CH2-CH3 portion of an antibody.

By "Fc fusion protein" or "immunoadhesin" herein is meant a protein comprising an Fc region, generally linked (optionally through a linker moiety, as described herein) to a different protein, such as to IL-15 and/or IL-15Rα, as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is a Fc fusion, comprising a variant Fc domain and a protein domain, such as an IL-15 complex. As outlined herein, in some embodiments, one monomer of the heterodimeric protein is an Fc fusion protein comprising an IL-15 complex and the other monomer is a traditional heavy chain (with an associated light chain).

By "position" as used herein is meant a location in the sequence of a protein. Positions may be numbered sequentially, or according to an established format, for example the EU index for antibody numbering.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target cell" as used herein is meant a cell that expresses the target antigen, in this case, PD-1, and/or IL-15 receptors.

By "wild type or WT" herein is meant an amino acid sequence or a nucleotide sequence that is found in nature, including allelic variations. A WT protein has an amino acid sequence or a nucleotide sequence that has not been intentionally modified.

The bispecific heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins having different binding specificities. "Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

"Specific binding" or "specifically binds to" or is "specific for" a particular antigen or an epitope (in this case, human PD-1) means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an ABD having a $K_D$ for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular ABD-antigen interaction. Typically, an ABD that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a surface plasmon resonance (SPR)-based assay (e.g. Biacore) or a bio-layer interferometry (BLI)-based assay (e.g. Octet).

III. Introduction

The invention provides targeted heterodimeric fusion proteins that can bind to the checkpoint inhibitor PD-1 antigen and can complex with the common gamma chain (γc; CD132) and/or the IL-2 receptor β-chain (IL-2Rβ; CD122) due to the presence of an IL-15 complex. In general, the heterodimeric fusion proteins of the invention have three functional components: an IL-15/IL-15Rα(sushi) component, generally referred to herein as an "IL-15 complex" or "IL-15/Rα complex", an anti-PD-1 component which serves as a "targeting" moiety by bringing the fusion protein to a cell expressing PD-1, and an Fc component, each of which can take different forms and each of which can be combined with the other components in any configuration.

However, the anti-PD-1 component of the targeted heterodimeric fusion proteins of the invention do not compete for binding with known anti-PD-1 antibodies such as nivolumab and pembrolizumab. That is, by including an anti-PD-1 (αPD-1) antigen binding domain (ABD) that does not compete for binding with approved αPD-1 antibodies ("NC[PD-1]"), the fusion proteins of the invention allows for efficient combination therapies with anti-PD-1 antibody therapies. That is, by including an anti-PD-1 ABD that does not compete for binding ("NC-αPD-1 ABD") with approved treatments, the non-competing ABD can be used to target the fusion proteins to the tumor, but still allow for therapeutic treatment with an additional anti-PD-1 antibody, since both can non-competitively bind to PD-1. Additionally, in some embodiments, the NC-αPD-1 ABDs also can either completely block the interaction of the PD-1:PD-L1 (embodiments based on the mAb A variants), partially block the interaction (mAbC variants), or not block at all the interaction (mAbB variants).

As will be appreciated by those in the art and outlined herein, a number of different formats for the different targeted heterodimeric fusion proteins, the non-competing constructs, "NC-αPD-1×IL-15/Rα" are shown in FIG. 28.

Additionally, the invention relies on comparisons of the present embodiments to "untargeted IL-15/Rα-Fc fusion proteins", that do not contain an antigen binding domain to a human PD-1, as depicted in FIG. 13.

Furthermore, either the untargeted or the targeted heterodimeric fusion proteins of the invention can be combined with other antibodies to checkpoint receptors, including anti-PD-1, anti-TIM-3, anti-LAG-3, anti-TIGIT, etc.

Accordingly, the present invention provides a number of different functional components which can be assembled in a number of different ways to generate the heterodimeric fusion proteins of the invention. As discussed above, the fusion proteins include an IL-15 complex that includes an IL-15 domain and an IL-15 receptor component.

A. IL-15 Complexes

As shown in the figures, the IL-15 complex can take several forms. As stated above, the IL-15 protein on its own is less stable than when complexed with the IL-15Rα protein. As is known in the art, the IL-15Rα protein contains a "sushi domain", which is the shortest region of the receptor that retains IL-15 binding activity and is SEQ ID NO:4. Thus, while heterodimeric fusion proteins comprising the entire extracellular domain of the IL-15Rα protein (SEQ ID NO:3) or functional fragments (e.g. larger than SEQ ID NO:4 but not all of SEQ ID NO:3) can be made, preferred embodiments herein include complexes that just use the sushi domain.

Accordingly, the IL-15 complexes generally comprises the IL-15 protein and the sushi domain of IL-15Rα (unless otherwise noted that the full length sequence is used, "IL-15Rα", "IL-15Rα(sushi)" and "sushi" are used interchangeably throughout). When complexed together, the nomenclature is depicted with a "slash", "/", as "IL-15/Rα", meaning that there is an IL-15 domain and an IL-15Rα domain present.

1. IL-15 Domains

As will be appreciated by those in the art, the IL-15 domain can be either a wild type human sequence, or can be engineered to include variants, particularly potency variants as discussed below.

In some embodiments, the human IL-15 protein has the amino acid sequence set forth in NCBI Ref. Seq. No. NP_000576.1 or SEQ ID NO:1, which is the precursor sequence. In some cases, the coding sequence of human IL-15 is set forth in NCBI Ref. Seq. No. NM_000585. An exemplary IL-15 protein of the Fc fusion heterodimeric protein outlined herein can have the amino acid sequence of SEQ ID NO:2 (mature IL-15), which corresponds to amino acids 49-162 of SEQ ID NO:1. In some embodiments, the IL-15 protein has at least 90%, e.g., 90%, 91%, 92%, 93%, 94%, 95%, 96%, 97%, 98%, 99%, or more sequence identity to SEQ ID NO:2.

In some embodiments, the IL-15 domain has been engineered to include amino acid substitutions.

Furthermore, in some embodiments, the IL-15 human protein is engineered to confer decreased potency as is generally described in PCT/US2019/028107, hereby incorporated by reference in its entirety. That is, as described therein, reduction in potency of IL-15 in the heterodimeric fusion proteins of the invention (optionally with and without Xtend-Fc substitutions described herein such as M428L/N434S) can enhance both pharmacodynamics and pharmacokinetics in subjects that are administered such proteins. Similarly, as shown in Example 7 of PCT/US2019/028107, that reduced potency IL-15/Rα-Fc variants such as XENP22821 can expand lymphocyte counts for a greater duration than wild-type IL-15/Rα-Fc fusion proteins described therein such as XENP20818. Notably, XENP23343, the Xtend-analog of XENP22821, further enhanced the duration of lymphocyte expansion beyond XENP22821. In addition, the reduction in potency of IL-15 can improve therapeutic index (i.e. enable higher dosing with less toxicity).

As illustrated in Example 14, the NC-αPD-1×IL-15/Rα-Fc fusion proteins can overcome Treg suppression of effector T cell proliferation.

Similarly, as shown in Example 4, below, NC-αPD-1× IL-15/Rα-Fc fusion proteins can promote leukocyte expansion and exacerbate xenogeneic GVHD over a range of dose levels. Notably, combination therapy of NC-αPD-1×IL-15/Rα-Fc fusion proteins and an anti-PD-1 antibody showed synergy (e.g., a synergic effect), particularly at a low dose.

As shown in Examples 3 and 8, ?PD-1×IL-15/R?-Fc fusion protein are selective for activated lymphocytes (e.g. those that would be found in the tumor environment).

Accordingly, the present invention provides a number of suitable IL-15 amino acid variants that confer reduced potency and increased pharmokinetics, including, but not limited to, variant IL-15 proteins comprising amino acid substitution(s) selected from the group of N1D; N4D; D8N; D30N; D61N; E64Q; N65D; Q108E; N1D/N4D/D8N; N1D/N4D/N65D; N1D/D30N; N1D/D61N; N1D/D61N/E64Q/Q108E; N1D/E64Q; N1D/N65D; N1D/Q108E; N4D; N4D/D30N; N4D/D61N; N4D/D61N/N65D; N4D/D61N/E64Q/Q108E; N4D/E64Q; N4D/N65D; D8N/D61N; D8N/E64Q; D30N/E64Q; D30N/N65D; D30N/E64Q/N65D; D30N/Q180E; D61N/E64Q/N65D; E64Q; E64Q/N65D; E64Q/Q108E; and N65D/Q108E.

In some embodiments, the amino acid substitution(s) may be isosteric substitutions at the IL-15:IL-2β and IL-15: common gamma chain interface In some embodiments, the human IL-15 protein, such as a human mature IL-15 protein of the Fc fusion protein is identical to the amino acid sequence of SEQ ID NO:2. In some cases, the human IL-15 protein such as the human mature IL-15 protein has no amino acid substitutions.

In some embodiments, the human mature IL-15 variant protein has one or more amino acid mutations (e.g., substitutions, insertions and/or deletions). In some instances, the mutation introduces a cysteine residue that can form a disulfide bond with human IL-15 receptor alpha (IL-15Rα) protein.

In some embodiments, the invention provides proteins comprising a human IL-15 variant with the amino acid variant D30N. In some embodiments, the protein comprises the amino acid sequence of SEQ ID NO:2 and a D30N substitution. In some embodiments, the protein comprises the amino acid sequence of SEQ ID NO:2 and at least a D30N substitution.

In some embodiments, the invention provides proteins comprising a human IL-15 variant with the amino acid variant N1D. In some embodiments, the protein comprises the amino acid sequence of SEQ ID NO:2 and an N1D substitution. In some embodiments, the protein comprises the amino acid sequence of SEQ ID NO:2 and at least an N1D substitution.

In some embodiments, the invention provides proteins comprising a human IL-15 variant with the amino acid variant N4D. In some embodiments, the protein comprises the amino acid sequence of SEQ ID NO:2 and an N4D substitution. In some embodiments, the protein comprises the amino acid sequence of SEQ ID NO:2 and at least an N4D substitution.

In some embodiments, the invention provides proteins comprising a human IL-15 variant with the amino acid variant E64Q. In some embodiments, the protein comprises the amino acid sequence of SEQ ID NO:2 and an E64Q substitution. In some embodiments, the protein comprises the amino acid sequence of SEQ ID NO:2 and at least an E64Q substitution.

In some embodiments, the invention provides proteins comprising a human IL-15 variant with the amino acid variant N65D. In some embodiments, the protein comprises the amino acid sequence of SEQ ID NO:2 and an N65D substitution. In some embodiments, the protein comprises the amino acid sequence of SEQ ID NO:2 and at least an N65D substitution.

In some embodiments, the invention provides proteins comprising a human IL-15 variant with amino acid substitutions N1D/D30N. In some embodiments, the protein comprises the amino acid sequence of SEQ ID NO:2 and N1D/D30N substitutions. In some embodiments, the protein comprises the amino acid sequence of SEQ ID NO:2 and at least N1D/D30N substitutions.

In some embodiments, the invention provides proteins comprising a human IL-15 variant with amino acid substitutions N4D/D30N. In some embodiments, the protein comprises the amino acid sequence of SEQ ID NO:2 and N4D/D30N substitutions. In some embodiments, the protein comprises the amino acid sequence of SEQ ID NO:2 and at least N4D/D30N substitutions.

In some embodiments, the invention provides proteins comprising a human IL-15 variant with amino acid substitutions D30N/E64Q. In some embodiments, the protein comprises the amino acid sequence of SEQ ID NO:2 and D30N/E64Q substitutions. In some embodiments, the protein comprises the amino acid sequence of SEQ ID NO:2 and at least D30N/E64Q substitutions.

In some embodiments, the invention provides proteins comprising a human IL-15 variant with amino acid substitutions D30N/N65D. In some embodiments, the protein comprises the amino acid sequence of SEQ ID NO:2 and D30N/N65D substitutions. In some embodiments, the protein comprises the amino acid sequence of SEQ ID NO:2 and at least D30N/N65D substitutions.

In some embodiments, the invention provides proteins comprising a human IL-15 variant with amino acid substitutions N4D/N65D. In some embodiments, the protein comprises the amino acid sequence of SEQ ID NO:2 with N4D/N65D substitutions. In some embodiments, the protein comprises the amino acid sequence of SEQ ID NO:2 and at least N4D/N65D substitutions.

In some embodiments, the invention provides proteins comprising a human IL-15 variant with amino acid substitutions D30N/E64Q/N65D. In some embodiments, the protein comprises the amino acid sequence of SEQ ID NO:2 with D30N/E64Q/N65D substitutions. In some embodiments, the protein comprises the amino acid sequence of SEQ ID NO:2 and at least D30N/E64Q/N65D substitutions.

2. IL-15/Rα Domains

In addition to a IL-15 domain, optionally including amino acid variants as outlined above, the heterodimeric fusion proteins of the invention include a "sushi" domain.

In some embodiments, the human IL-15 receptor alpha (IL-15Rα) protein has the amino acid sequence set forth in NCBI Ref. Seq. No. NP_002180.1 or SEQ ID NO:3. In some cases, the coding sequence of human IL-15Rα is set forth in NCBI Ref Seq. No. NM_002189.3. An exemplary IL-15Rα protein of the Fc fusion heterodimeric protein outlined herein can comprise or consist of the sushi domain of SEQ ID NO:3 (e.g., amino acids 31-95 of SEQ ID NO:3), or in other words, the amino acid sequence of SEQ ID NO:4. That is, particular embodiments utilize a truncated version of the extracellular domain of the receptor.

In some embodiments, the IL-15Rα protein has the amino acid sequence of SEQ ID NO:4 and an amino acid insertion selected from the group consisting of D96, P97, A98, D96/P97, D96/C97, D96/P97/A98, D96/P97/C98, and D96/C97/A98, wherein the amino acid position is relative to full-length human IL-15Rα protein or SEQ ID NO:3. For instance, amino acid(s) such as D (e.g., Asp), P (e.g., Pro), A (e.g., Ala), DP (e.g., Asp-Pro), DC (e.g., Asp-Cys), DPA (e.g., Asp-Pro-Ala), DPC (e.g., Asp-Pro-Cys), or DCA (e.g., Asp-Cys-Ala) can be added to the C-terminus of the IL-15Rα protein of SEQ ID NO:4. In some embodiments, the IL-15Rα protein has the amino acid sequence of SEQ ID NO:4 and one or more amino acid substitutions selected from the group consisting of K34C, A37C, G38C, S40C, and L42C, wherein the amino acid position is relative to SEQ ID NO:4. The IL-15Rα (sushi) protein of SEQ ID NO:4 can have 1, 2, 3, 4, 5, 6, 7, 8 or more amino acid mutations (e.g., substitutions, insertions and/or deletions).

3. IL-15 Complexes in Different Formats

Accordingly, the IL-15 complexes generally comprises the IL-15 protein and the sushi domain of IL-15Rα. When complexed together, the nomenclature is depicted with a "slash", "/", as "IL-15/Rα", meaning that there is an IL-15 domain and an IL-15Rα domain present.

As are depicted in FIG. 28, the IL-15/Rα complex can be in two different formats; either a non-covalent association or a covalent complex. As shown in FIGS. 28B, 28D, 28F and 28G, the IL-15 protein and the IL-15Rα(sushi) are not covalently attached, but rather are self-assembled through regular ligand-ligand interactions. As is more fully described herein, it can be either the IL-15 domain or the sushi domain that is covalently linked to the Fc domain (generally using an optional domain linker).

Figure 28A:
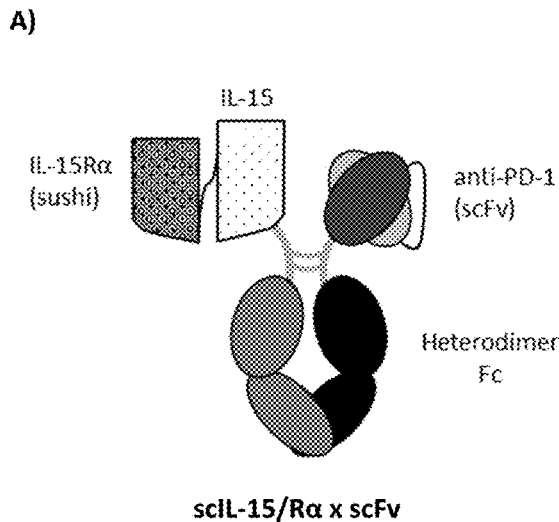
Figure 28B:
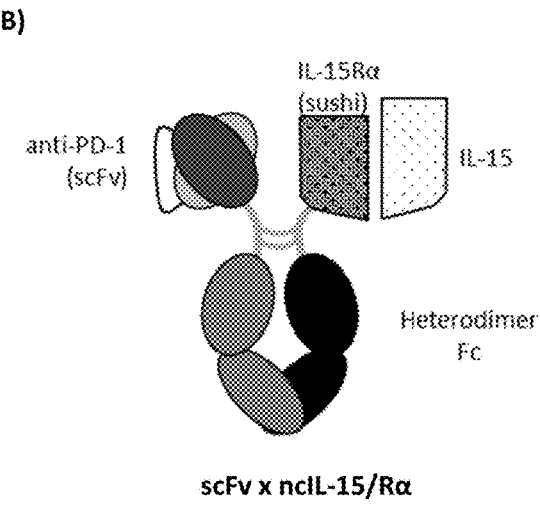
Figure 28C:
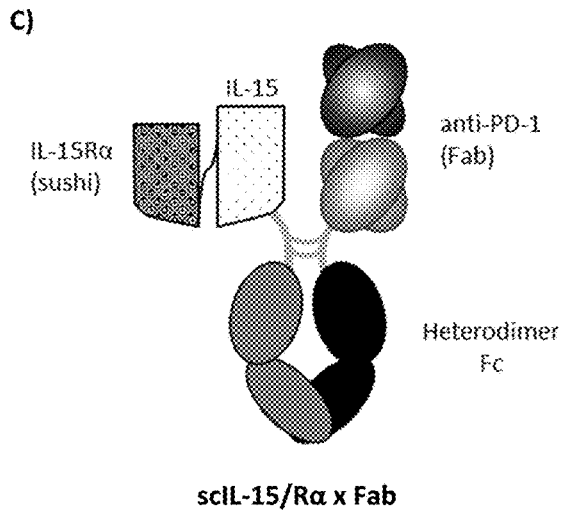
Figure 28D:
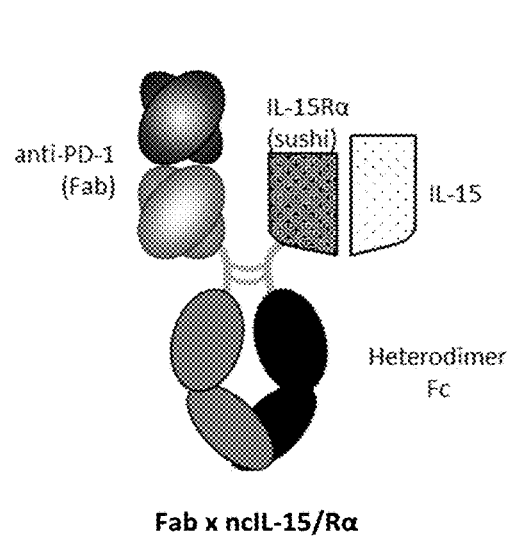
Figure 28E:
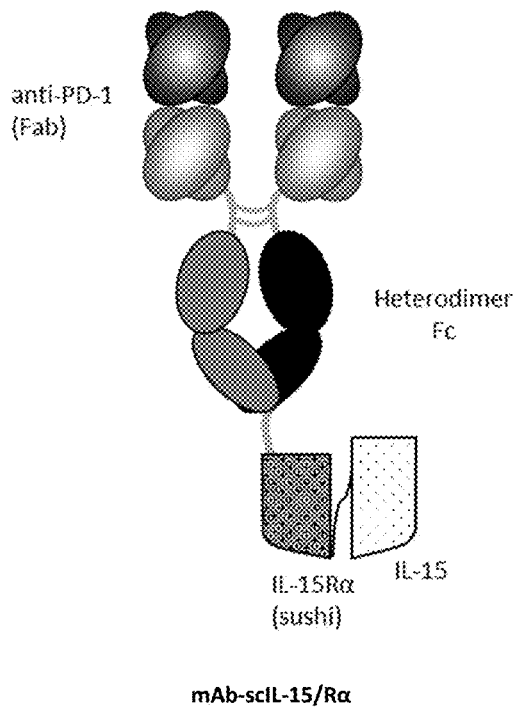

Alternatively, the IL-15/Rα complex is a covalent attachment using a domain linker as generally shown in FIGS. 28A, 28C, 28E and 28H. In each of these cases, the N- to C-terminal orientation of the IL-15 and the IL-15Rα can switched: that is, in FIG. 28A, the invention also includes the case where the IL-15 domain is at the N-terminus, with the IL-15Rα domain being attached using a linker to the Fc domain. Similarly, in FIG. 28C, the invention also includes the case where the IL-15 domain is at the N-terminus, with the IL-15Rα domain being attached using a linker to the Fc domain. FIG. 28E the invention also includes the case where the IL-15 domain is at the C-terminus of the Fc domain (linked using a domain linker), with the IL-15Rα domain being attached using a linker to the IL-15 domain. Finally, FIG. 28H can also include the case where the IL-15 domain is N-terminal to the IL-15Rα domain.

B. Non-Competing Anti-PD-1 Antigen Binding Domains

The anti-PD-1 component (e.g., the anti-PD-1 antigen binding domain (ABD)) of the invention is generally a set of 6 CDRs included within a variable heavy domain and a variable light domain that form an Fv domain that can bind human PD-1 (the sequence of which is depicted in FIG. 2) but do not compete with commercial anti-PD-1 antibodies such as pembroluzimab and nivolimab. This allows for superb targeting of the heterodimeric fusion proteins of the invention to tumors, thus allowing local action of the IL-15/Rα complexes, but also allowing combination treatments with efficacious anti-PD-1 antibodies, without competing for the same PD-1 eptiopes.

The NC-αPD-1 antigen binding domains of the invention can take on two general formats, either as a scFv domain, such as those depicted in FIGS. 28A and 28B, or as a Fab domain, present on two different polypeptides, such as those depicted in FIGS. 28C and 28D (monovalent binding of PD-1) and FIGS. 28E, 28F, 28G and 28H (bivalent binding of PD-1), which are more fully described below.

There are large number of VH and VL domains that find use in the present constructs, a number of which are shown in figures including specifically in FIG. 43, which includes VH and VL sequences for antigen binding domains that do not compete for binding with pembrolizumab and nivolumab. It should be noted that any of the VH domains can be combined with any of the VL domains, with useful particular combinations below.

1. VH Domains

With particular regard to mAbC variants, there are also a set of useful affinity variants of the VH domain, as shown in FIG. 65. In these embodiments, particularly useful amino acid substitutions in the VH domain, as compared to mAbC_H1, include, but are not limited to, F32L, S52aG, R97E, R97Y and R97W, which can be used alone or in combination. In particular, the VH combinations that find specific use in some embodiments in addition to the five single amino acid variants include, but are not limited to, F32L/S52aG and F32L/S52aG/R97W.

In some aspects, the VH domain of the NC-PD-1 ABD is selected from those depicted in FIG. 43.

In some aspects, the NC-PD-1 ABD is based on the mAbC parent (H1_L1, sequences shown in FIG. 43), and the VH domain of the mAbC variant is selected from the group consisting of H1, H1.1, H1.2, H1.3, etc. to H1.168 of FIG. 43.

In some aspects, the NC-PD-1 ABD is based on the mAbC parent (H1_L1, sequences shown in FIG. 43), and the VH domain of the mAbC variant is selected from the group consisting of H1.19, H1.48, H1.125, H1.130, H1.132, H1.169 and H1.175 of FIG. 43.

2. VL Domains

With particular regard to mAbC variants, there are also a set of useful affinity variants of the VL, as shown in FIG. 65. In these embodiments, particularly useful amino acid substitutions in the VL domain, as compared to mAbC L1, include, but are not limited to, N27dH, N27dS, K30Y, S93T and Y94W, which can be used alone or in combination.

In some aspects, the VL domain of the mAbC variant is selected from the group consisting of L1.1, L1.3, L1.45, L1.117, L1.135, L1.136 and L1.140.

3. VH and VL Combinations

Within parental backbones, e.g. within mAbC sequences, the VL and VH domains can be interchangeable, as is generally depicted in FIG. 63.

Of particular use in some embodiments are the combination of a VH selected from the group consisting of H1, H1.1, H1.2, H1.3, H1.4, H1.5, H1.6, H1.7, H1.8, H1.9, H1.10, etc. to H1.168 (inclusive) and H1.175 and L1.140.

Of particular use in some embodiments are the combination of a VH selected from the group consisting of H1, H1.1, H1.2, H1.3, H1.4, H1.5, H1.6, H1.7, H1.8, H1.9, H1.10, etc. to H1.168 (inclusive) and H1.175 and L1.1.

A particular combination that finds use in the present invention is mAb C H1.19_L1.140.

A particular combination that finds use in the present invention is mAb C H1_L1.1.

Of particular use in some embodiments are VH and VL domain combinations of H1.19_L1.140, H1_L1.1, H1.19_L1, H1.48_L1, H1.125_L1, H1.30_L1, H1.132_L1, H1_L1.1H1_L1.3, H1_L1.45, H1_L1.117, H1_L1.129, H1.19_L1.1, H1.32_L1.1, H1.169_L1.1, H1.169_L1.1, H1.175_L1.1, H1.175_L1.1, H1_L1.140, H1_L1.135, H1_L1.136, H1.132_L1.135, H1.132_L1.140, H1.175_L1.135 and H1.175_L1.140.

Additional combinations of VH and VL domains from mAbC that find use in the present invention include, but are not limited to, mAb A[PD-1]_H1 and mAb A[PD-1]_L1; mAb B[PD-1]_H1 and mAb B[PD-1]_L1; mAb C[PD-1]_ H1 and mAb C[PD-1]_L1; mAb C[PD-1]_H1 and mAb C[PD-1]_L1.1; mAb C[PD-1]_H1 and mAb C[PD-1]_L1.3; mAb C[PD-1]_H1 and mAb C[PD-1]_L1.45; mAb C[PD- 1]_H1 and mAb C[PD-1]_L1.117; mAb C[PD-1]_H1 and mAb C[PD-1]_L1.135; mAb C[PD-1]_H1 and mAb C[PD-1]_L1.140; mAb C[PD-1]_H1 and mAb C[PD-1]_L2; mAb C[PD-1]_H1.132 and mAb C[PD-1]_L1; mAb C[PD-1]_H1.132 and mAb C[PD-1]_L1.1; mAb C[PD-1]_H1.132 and mAb C[PD-1]_L1.3; mAb C[PD-1]_H1.132 and mAb C[PD-1]_L1.45; mAb C[PD-1]_H1.132 and mAb C[PD-1]_L1.117; mAb C[PD-1]_H1.132 and mAb C[PD-1]_L1.135; mAb C[PD-1]_H1.132 and mAb C[PD-1]_L1.140; mAb C[PD-1]_H1.132 and mAb C[PD-1]_L2; mAb C[PD-1]_H2 and mAb C[PD-1]_L1; mAb C[PD-1]_H2 and mAb C[PD-1]_L1.1; mAb C[PD-1]_H2 and mAb C[PD-1]_L1.3; mAb C[PD-1]_H2 and mAb C[PD-1]_L1.45; mAb C[PD-1]_H2 and mAb C[PD-1]_L1.117; mAb C[PD-1]_H2 and mAb C[PD-1]_L1.135; mAb C[PD-1]_H2 and mAb C[PD-1]_L1.140; and mAb C[PD-1]_H2 and mAb C[PD-1]_L2.

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIGS. 4A-4B of U.S. 62/353,511).

As shown herein, the anti-PD-1 ABD can alternatively be in the form of a scFv, wherein the vh and vl domains are joined using an scFv linker, which can be optionally a charged scFv linker. As will be appreciated by those in the art, the scFv can be assembled from N- to C-terminus as N-vh-scFv linker-vl-C or as N-vl-scFv linker-vh-C, with the C terminus of the scFv domain generally being linked to the hinge-CH2-CH3 Fc domain. Suitable Fvs (including CDR sets and variable heavy/variable light domains) can be used in scFv formats or Fab formats are shown in FIG. 43. As will further be appreciated by those in the art, all or part of the hinge (which can also be a wild type hinge from IgG1, IgG2 or IgG4 or a variant thereof, such as the IgG4 S241P or S228P hinge variant with the substitution proline at position 228 relative to the parent IgG4 hinge polypeptide (wherein the numbering S228P is according to the EU index and the S241P is the Kabat numbering)) can be used as the domain linker between the scFv and the CH2-CH3 domain, or a different domain linker such as depicted in the Figures can be used.

C. Fc Domains

In addition to the IL-15 complexes and the targeting NC-αPD-1 Fv domains, the invention further provides heterodimeric Fc domains as a component. As shown in FIG. 28, these heterodimeric Fc domains serve to bring the IL-15/Rα and the targeting anti-PD-1 domains together in a single construct, generally comprising either two polypeptide chains (e.g. FIG. 28A, where one monomer comprises the IL-15/Rα complex and the other monomer comprises the anti-PD-1 scFv), three polypeptide chains (e.g. FIG. 28C, where one monomer comprises the IL-15/Rα complex, a second monomer comprises a heavy chain and the third monomer is the light chain), etc.

The Fc domain component of the invention is as described herein, which generally contains skew variants and/or optional pI variants and/or ablation variants are outlined herein. See for example the disclosure of WO2017/218707 under the heading "IV Heterodimeric Antibodies", including sections IV.A, IV.B, IV.C, IV.D, IV.E, IV.F, IV.G, IV.H and IV.I, all of which are expressly incorporated by reference in their entirety. Of particular use in the heterodimeric proteins of the present invention are Fc domains containing "skew variants", "pI variants", "ablation variants" and FcRn variants as outlined therein. Particularly useful Fc domains are those shown in FIG. 8.

The Fc domains can be derived from IgG Fc domains, e.g., IgG1, IgG2, IgG3 or IgG4 Fc domains, with IgG1 Fc domains finding particular use in the invention. The following describes Fc domains that are useful for IL-15/IL-15Rα Fc fusion monomers and checkpoint antibody fragments of the heterodimeric Fc proteins of the present invention.

Thus, the present invention provides different antibody domains, e.g., different Fc domains. As described herein and known in the art, the heterodimeric proteins of the invention comprise different domains, which can be overlapping as well. These domains include, but are not limited to, the Fc domain, the CH1 domain, the CH2 domain, the CH3 domain, the hinge domain, and the heavy constant domain (CH1-hinge-Fc domain or CH1-hinge-CH2-CH3).

Thus, the Fc domain includes the —CH2-CH3 domain, and optionally a hinge domain, and can be from human IgG1, IgG2, IgG3 or IgG4, with Fc domains derived from IgG1. In some of the embodiments herein, when a protein fragment, e.g., IL-15 or IL-15Rα is attached to an Fc domain, it is the C-terminus of the IL-15 or IL-15Rα construct that is attached to all or part of the hinge of the Fc domain; for example, it is generally attached to the sequence EPKS (SEQ ID NO: 7) which is the beginning of the hinge. In other embodiments, when a protein fragment, e.g., IL-15 or IL-15Rα, is attached to an Fc domain, it is the C-terminus of the IL-15 or IL-15Rα construct that is attached to the CH1 domain of the Fc domain.

In some of the constructs and sequences outlined herein of an Fc domain protein, the C-terminus of the IL-15 or IL-15Rα protein fragment is attached to the N-terminus of a domain linker, the C-terminus of which is attached to the N-terminus of a constant Fc domain (N-IL-15 or IL-15Rα protein fragment-linker-Fc domain-C) although that can be switched (N-Fc domain-linker-IL-15 or IL-15Rα protein fragment-C). In other constructs and sequence outlined herein, C-terminus of a first protein fragment is attached to the N-terminus of a second protein fragment, optionally via a domain linker, the C-terminus of the second protein fragment is attached to the N-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

Accordingly, in some embodiments the present invention provides heterodimeric Fc fusion proteins that rely on the use of two different heavy chain variant Fc sequences, that will self-assemble to form a heterodimeric Fc domain fusion polypeptides that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers.

1. Heterodimerization Variants

The heterodimeric IL-15/RαxNCPD-1-Fc fusion proteins include two different Fc domains (one on each of the first and second monomers) that include modifications that facilitate the heterodimerization of the first and second monomers and/or allow for ease of purification of heterodimers over homodimers, collectively referred to herein as "heterodimerization variants." As discussed below, heterodimerization variants can include skew variants (e.g., variants that "skew" the formation of heterodimers over homodimers, described below) as well as "pI variants" that facilitates the separation of homodimers away from heterodimers. As is generally described in U.S. Pat. No. 9,605,084, hereby incorporated by reference in its entirety and specifically as below for the discussion of heterodimerization variants, useful additional mechanisms for heterodimerization include "knobs and holes" ("KIH") as described in U.S. Pat. No. 9,605,084, "electrostatic steering" or "charge pairs" as described in U.S. Pat. No. 9,605,084, pI variants as described in U.S. Pat. No. 9,605,084, and general additional Fc variants as outlined in U.S. Pat. No. 9,605,084 and below.

a. Skew Variants

In some embodiments, the heterodimeric fusion proteins include skew variants, which are one or more amino acid modifications in a first Fc domain (A) and/or a second Fc domain (B) that favor the formation of Fc heterodimers (Fc dimers that include the first and the second Fc domain; A-B) over Fc homodimers (Fc dimers that include two of the first Fc domain or two of the second Fc domain; A-A or B-B). Suitable skew variants are included in the FIG. 29 of US Publ. App. No. 2016/0355608, hereby incorporated by reference in its entirety and specifically for its disclosure of skew variants, as well as in FIG. 4.

One mechanism for skew variants is generally referred to in the art as "knobs and holes," referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety and specifically for the disclosure of "knobs and holes" mutations. This is sometime referred to herein as "steric variants." The figures identify a number of "monomer A-monomer B" pairs that rely on "knobs and holes". In addition, as described in Merchant et al., Nature Biotech. 16:677 (1998), these "knobs and holes" mutations can be combined with disulfide bonds to further favor formation of Fc heterodimers.

An additional mechanism for skew variants that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs." In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "skew variants". These include, but are not limited to, D221E/P228E/L368E paired with D221R/P228R/K409R (e.g., these are "monomer" corresponding sets) and C220E/P228E/368E paired with C220R/E224R/P228R/K409R.

In some embodiments, the skew variants advantageously and simultaneously favor heterodimerization based on both the "knobs and holes" mechanism as well as the "electrostatic steering" mechanism. In some embodiments, the heterodimeric fusion proteins include one or more sets of such heterodimerization skew variants. Exemplary skew variants that fall into this category include: S364K/E357Q:L368D/K370S; L368D/K370S:S364K; L368E/K370S:S364K; T411T/E360E/Q362E:D401K; L368D/K370S:S364K/E357L; K370S:S364K/E357Q; or a T366S/L368A/Y407V:T366W (optionally including a bridging disulfide, T366S/L368A/Y407V/Y349C:T366W/S354C). These variants come in "pairs" of "sets." That is, one set of the pair is incorporated into the first monomer and the other set of the pair is incorporated into the second monomer. In terms of nomenclature, the pair "S364K/E357Q:L368D/K370S" means that one of the monomers includes an Fc domain that includes the amino acid substitutions S364K and E357Q and the other monomer includes an Fc domain that includes the amino acid substitutions L368D and K370S; as above, the "strandedness" of these pairs depends on the starting pI. It should be noted that these sets do not necessarily behave as "knobs in holes" variants, with a one-to-one correspondence between a residue on one monomer and a residue on the other. That is, these pairs of sets may instead form an interface between the two monomers that encourages heterodimer formation and discourages homodimer formation, allowing the percentage of heterodimers that spontaneously form under biological conditions to be over 90%, rather than the expected 50% (25% homodimer A/A:50% heterodimer A/B:25% homodimer B/B). Exemplary heterodimerization "skew" variants are depicted in FIG. 4.

In exemplary embodiments, the heterodimeric fusion proteins include a S364K/E357Q:L368D/K370S; L368D/K370S:S364K; L368E/K370S:S364K; T411T/E360E/Q362E:D401K; L368D/K370S:S364K/E357L; K370S:S364K/E357Q; or a T366S/L368A/Y407V:T366W (optionally including a bridging disulfide, T366S/L368A/Y407V/Y349C:T366W/S354C) "skew" variant amino acid substitution set. In an exemplary embodiment, the heterodimeric IL-15-Fc fusion protein includes a "S364K/E357Q:L368D/K370S" amino acid substitution set.

In some embodiments, the skew variants provided herein can be optionally and independently incorporated with any other modifications, including, but not limited to, other skew variants (see, e.g., in FIG. 37 of US Publ. App. No. 2012/0149876, herein incorporated by reference, particularly for its disclosure of skew variants), pI variants, isotpypic variants, FcRn variants, ablation variants, etc. into one or both of the first and second Fc domains of the IL-15-Fc fusion protein. Further, individual modifications can also independently and optionally be included or excluded from the subject IL-15-Fc fusion proteins.

b. pI (Isoelectric point) Variants for Heterodimers

In some embodiments, the heterodimeric fusion proteins includes purification variants that advantageously allow for the separation of heterodimeric fusion proteins from homodimeric proteins.

There are several basic mechanisms that can lead to ease of purifying heterodimeric proteins. One such mechanism relies on the use of pI variants which include one or more modifications that affect the isoelectric point of one or both of the monomers of the fusion protein, such that each monomer, and subsequently each dimeric species, has a different pI, thus allowing the isoelectric purification of A-A, A-B and B-B dimeric proteins. Alternatively, some formats also allow separation on the basis of size. As is further outlined above, it is also possible to "skew" the formation of heterodimers over homodimers using skew variants. Thus, a combination of heterodimerization skew variants and pI variants find particular use in the subject IL-15 fusion proteins provided herein.

Additionally, as more fully outlined below, depending on the format of the heterodimeric Fc fusion protein, pI variants can be either contained within the constant region and/or Fc domains of a monomer, and/or domain linkers can be used. In some embodiments, the heterodimeric IL-15-Fc fusion protein includes additional modifications for alternative functionalities can also create pI changes, such as Fc, FcRn and KO variants.

In the embodiments that utilizes pI as a separation mechanism to allow the purification of heterodimeric fusion proteins, amino acid modifications can be introduced into one or both of the monomers of the heterodimeric fusion protein. That is, the pI of one of the monomers (referred to herein for simplicity as "monomer A") can be engineered away from monomer B, or both monomer A and B can be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glutamine to glutamic acid), changing a charged residue from positive or negative to the opposite charge (e.g. aspartic acid to lysine) or changing a charged residue to a neutral residue (e.g., loss of a charge; lysine to serine.). A number of these variants are shown in the figures, including, FIGS. 4 and 5.

Creating a sufficient change in pI in at least one of the monomers such that heterodimers can be separated from homodimers can be done by using a "wild type" heavy chain constant region and a variant region that has been engineered to either increase or decrease its pI (wt A:B+ or wt A:B−), or by increasing one region and decreasing the other region (A+:B− or A−:B+).

Thus, in general, a component of some embodiments of the present subject fusion proteins are amino acid variants in the Fc domains or constant domain regions that are directed to altering the isoelectric point (pI) of at least one, if not both, of the monomers of a dimeric protein by incorporating amino acid substitutions ("pI variants" or "pI substitutions") into one or both of the monomers. The separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) of a heterodimeric fusion protein to achieve good separation will depend in part on the starting pI of the components. That is, to determine which monomer to engineer or in which "direction" (e.g., more positive or more negative), the sequences of the Fc domains and any IL-15 complex or linker included in each monomer are calculated and a decision is made from there based on the pIs of the monomers. As is known in the art, different Fc domains, linkers and IL-15 complexes will have different starting pIs. In general, as outlined herein, the pIs are engineered to result in a total pI difference of each monomer of at least about 0.1 logs, with 0.2 to 0.5 being preferred as outlined herein.

In general, as will be appreciated by those in the art, there are two general categories of amino acid modifications that affect pI: those that increase the pI of the protein (basic changes) and those that decrease the pI of the protein (acidic changes). As described herein, all combinations of these variants can be used: one monomer may include a wild type Fc domain, or a variant Fc domain that does not display a significantly different pI from wild-type, and the other monomer includes a Fc domain that is either more basic or more acidic. Alternatively, each monomer may be changed, one to more basic and one to more acidic.

In the case where pI variants are used to achieve heterodimerization, a more modular approach to designing and purifying heterodimeric fusion proteins is provided. Thus, in some embodiments, heterodimerization variants (including skew and pI variants) must be engineered. In addition, in some embodiments, the possibility of immunogenicity resulting from the pI variants is significantly reduced by importing pI variants from different IgG isotypes such that pI is changed without introducing significant immunogenicity (see isotypic variants below). Thus, an additional problem to be solved is the elucidation of low pI constant domains with high human sequence content, e.g. the minimization or avoidance of non-human residues at any particular position. Alternatively or in addition to isotypic substitutions, the possibility of immunogenicity resulting from the pI variants is significantly reduced by utilizing isosteric substitutions (e.g. Asn to Asp; and Gln to Glu).

A side benefit that can occur with this pI engineering is also the extension of serum half-life and increased FcRn binding. That is, as described in US Publ. App. No. US 2012/0028304 (incorporated by reference in its entirety and specifically for the disclosure of pI variants that provide additional function), lowering the pI of antibody constant domains (including those found in Fc fusions) can lead to longer serum retention in vivo. These pI variants for increased serum half-life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

Exemplary combinations of pI variants are shown in FIGS. 4 and 5, and FIG. 30 of US Publ. App. No. 2016/0355608, all of which are herein incorporated by reference in its entirety and specifically for the disclosure of pI variants. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, the heterodimeric fusion proteins include a monomer with a variant Fc domain having pI variant modifications 295E/384D/418E/421D (Q295E/N384D/Q418E/N421D when relative to human IgG1). In one embodiment, the heterodimeric fusion proteins include a monomer with a variant Fc domain having pI variant modifications 217R/228R/276K (P217R/P228R/N276K when relative to human IgG1). Additional exemplary pI variant modification that can be incorporated into the Fc domain of a subject are depicted in FIG. 5.

In some embodiments, modifications are made in the hinge of the Fc domain, including positions 216, 217, 218, 219, 220, 221, 222, 223, 224, 225, 226, 227, 228, 229, and 230 based on EU numbering. Thus, pI mutations and particularly substitutions can be made in one or more of positions 216-230, with 1, 2, 3, 4 or 5 mutations finding use. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339, based on EU numbering. It should be noted that changes in 233-236 can be made to increase effector function (along with 327A) in the IgG2 backbone. Again, all possible combinations of these 14 positions can be made; e.g., an IL-15-Fc fusion protein may include a variant Fc domain with 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the modifications can be independently and optionally selected from position 355, 359, 362, 384, 389, 392, 397, 418, 419, 444 and 447 (EU numbering) of the CH3 region. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

c. Isotypic Variants

In addition, some embodiments of the fusion proteins provided herein rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference, particularly for its disclosure of isotypic variants. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant Fc fusion protein. However, it should be noted as discussed below that even changes in IgG2 molecules allow for increased serum half-life.

In other embodiments, non-isotypic amino acid modifications are made, either to reduce the overall charge state of the resulting protein (e.g., by changing a higher pI amino acid to a lower pI amino acid), or to allow accommodations in structure for stability, etc. as is further described below.

In addition, by pI engineering both the heavy and light constant domains, significant modifications in each monomer of the heterodimer can be seen. As discussed herein, having the pIs of the two monomers differ by at least 0.5 can allow separation by ion exchange chromatography or isoelectric focusing, or other methods sensitive to isoelectric point.

d. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

e. pI Variants that also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

2. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

a. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/ 428L and 259I/308F/428L.

b. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific immunomodulatory antibodies desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

Exemplary embodiments of pI variants are provided in the Figures including FIG. 5.

3. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411T/E360E/Q362E:D401K; L368D/K370S: S364K/E357L, K370S:S364K/E357Q, T366S/L368A/Y407V:T366W and T366S/L368A/Y407V/Y349C:T366W/S354C, optionally ablation variants, optionally charged domain linkers and the heavy chain comprises pI variants.

In some embodiments, the Fc domain comprising an amino acid substitution selected from the group consisting of: 236R, 239D, 239E, 243L, M252Y, V259I, 267D, 267E, 298A, V308F, 328F, 328R, 330L, 332D, 332E, M428L, N434A, N434S, 236R/328R, 239D/332E, M428L, 236R/328F, V259I/V308F, 267E/328F, M428L/N434S, Y436I/M428L, Y436V/M428L, Y436I/N434S, Y436V/N434S, 239D/332E/330L, M252Y/S254T/T256E, V259I/V308F/M428L, E233P/L234V/L235A/G236del/S267K, G236R/L328R and PVA/S267K. In some cases, the Fc domain comprises the amino acid substitution 239D/332E. In other cases, the Fc domain comprises the amino acid substitution G236R/L328R or PVA/S267K.

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprises Q295E/N384D/Q418E/N481D and the other a positively charged domain linker. As will be appreciated in the art, the "knobs in holes" variants do not change pI, and thus can be used on either monomer.

In one embodiment, a particular combination of skew and pI variants that finds use in the present invention is L368D/K370S:S364K/E357Q with one monomer comprising Q295E/N384D/Q418E/N421D.

Useful pairs of Fc dimerization variant sets (including skew and pI variants) are provided in FIGS. 4A-4E. Additional pI variants are provided in FIG. 5. Useful ablation variants are provided in FIG. 6. Useful embodiments of the non-cytokine components of the IL-15/Rα×anti-PD1 ABD heterodimeric fusion proteins of the present invention are provided in FIGS. 7A-7F and FIG. 8.

D. Domain Linkers

The three components of the invention, the anti-PD-1 Fv, the Il-15/Rα complex, and the heterodimerization Fc domains of the invention are optionally linked together using domain linkers. While direct covalent linking can be done (e.g. linking the C-terminus of the IL-15 complex to the N-terminus of the CH2 domain of the Fc domain), in general, linkers that provide flexibility, and sometimes function, are used.

In some embodiments, an IL-15 protein is attached to the N-terminus of an Fc domain, and an IL-15Rα protein is attached to the N-terminus of the IL-15 protein. In other embodiments, an IL-15Rα protein is attached to the N-terminus of an Fc domain and the IL-15Rα protein is non-covalently attached to an IL-15 protein. In yet other embodiments, an IL-15Rα protein is attached to the C-terminus of an Fc domain and the IL-15Rα protein is non-covalently attached to an IL-15 protein.

In some embodiments, the IL-15 protein and IL-15Rα protein are attached together via a linker (e.g., a "scIL-15/

Rα" format). Optionally, the proteins are not attached via a linker, and utilize either native self-assembly or disulfide bonds as outlined herein. In other embodiments, the IL-15 protein and IL-15Rα protein are noncovalently attached. In some embodiments, the IL-15 protein is attached to an Fc domain via a linker. In certain embodiments, the IL-15 protein is attached to an Fc domain directly, such as without a linker. In particular embodiments, the IL-15 protein is attached to an Fc domain via a hinge region or a fragment thereof. In other embodiments, the IL-15Rα protein is attached to an Fc domain via a linker. In other embodiments, the IL-15Rα protein is attached to an Fc domain directly, such as without a linker. In particular embodiments, the IL-15Rα protein is attached to an Fc domain via a hinge region or a fragment thereof. Optionally, a linker is not used to attach the IL-15 protein or IL-15Rα protein to the Fc domain.

In some instances, the PD-1 ABD is covalently attached to the N-terminus of an Fc domain via a linker, such as a domain linker. In some embodiments, the PD-1 ABD is attached to an Fc domain directly, such as without a linker. In particular embodiments, the PD-1 ABD is attached to an Fc domain via a hinge region or a fragment thereof.

In some embodiments, the linker is a "domain linker", used to link any two domains as outlined herein together. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n (SEQ ID NO: 8), (GSGGS)n (SEQ ID NO: 9), (GGGGS)n (SEQ ID NO: 10), and (GGGS)n (SEQ ID NO: 11), where n is an integer of at least one (and generally from 3 to 4), glycine-alanine polymers, alanine-serine polymers, and other flexible linkers. Alternatively, a variety of non-proteinaceous polymers, including but not limited to polyethylene glycol (PEG), polypropylene glycol, polyoxylkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the scFv linker is a charged scFv linker, a number of which are shown in FIG. 4A of U.S. 62/353,511. Accordingly, the present invention further provides charged scFv linkers, to facilitate the separation in pI between a first and a second monomer (e.g., an IL-15/IL-15Rα monomer and PD-1 ABD monomer). That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 10 can be used in any embodiment herein where a linker is utilized.

IV. Useful Formats of the Invention

As shown in FIGS. 28A-28H, there are a number of useful formats of the PD-1 targeted IL-15/IL-15Rα(sushi) Fc fusion proteins of the invention. In general, the heterodimeric fusion proteins of the invention have three functional components: an IL-15/IL-15Rα(sushi) component, an anti-PD-1 component, and an Fc component, each of which can take different forms as outlined herein and each of which can be combined with the other components in any configuration.

In any of the below formats, the first and the second Fc domains can have a set of amino acid substitutions selected from the group consisting of a) S267K/L368D/K370S: S267K/LS364K/E357Q; b) S364K/E357Q:L368D/K370S; c) L368D/K370S:S364K; d) L368E/K370S:S364K; e) T411T/E360E/Q362E:D401K; f) L368D/K370S:S364K/ E357L and g) K370S:S364K/E357Q, according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/ L235A/G236del/S239K/A327G, E233P/L234V/L235A/ G236del/S267K/A327G and E233P/L234V/L235A/ G236del, according to EU numbering.

Optionally, the first and/or second Fc domains have M428L/N434S variants for half-life extension. In some embodiments, the first and/or second Fc domains have 428L/434S variants for half-life extension.

Thus, particularly useful variants for any of the below formats have the positive monomer comprising the skew variants S364K/E357Q and the ablation variants E233P/ L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D (when the monomer contains a CH1 domain) or the pI variants Q295E/ N384D/Q418E/N421D (when the monomer does not contain a CH1 domain).

A. scIL-15/RαxscFv

One embodiment is shown in FIG. 28A, and comprises two monomers. This is generally referred to as "scIL-15/ RαxscFv", with the "sc" standing for "single chain" referring to the attachment of the IL-15 and sushi domain using a covalent linker. The "scIL-15/RαxscFv" format (see FIG. 28A) comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc.

In the FIG. 28A format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the mAbC VH and VL domain combinations of H1.19_L1.140, H1_L1.1, H1.19_L1, H1.48_L1, H1.125_L1, H1.30_L1, H1.132_L1, H1_L1.1H1_L1.3, H1_L1.45, H1_L1.117, H1_L1.129, H1.19_L1.1, H1.32_L1.1, H1.169_L1.1, H1.169_L1.1, H1.175_L1.1, H1.175_L1.1, H1_L1.140, H1_L1.135, H1_L1.136, H1.132_L1.135, H1.132_L1.140, H1.175_L1.135 and H1.175_L1.140.

In the FIG. 28A format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28A format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/N65D, D30N/N65D and D30N/E64Q/N65D.

B. scFv×ncIL-15/Rα

This embodiment is shown in FIG. 28B, and comprises three monomers. This is generally referred to as "ncIL-15/Rα×scFv" or "scFv×ncIL-15/Rα" with the "nc" standing for "non-covalent" referring to the self-assembling non-covalent attachment of the IL-15 and sushi domain. The "scFv×ncIL-15/Rα" format (see FIG. 34A-34B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed.

In the FIG. 28B format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28B format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/N65D, D30N/N65D and D30N/E64Q/N65D.

C. scIL-15/Rα×Fab

This preferred format is shown in FIG. 28C, and comprises three monomers. This is generally referred to as "scIL-15/Rα×Fab" or "Fab×scIL-15/Rα," as used interchangeably, with the "sc" standing for "single chain". The scIL-15/Rα×Fab format (see FIG. 28C) comprises IL-15Rα (sushi) fused to IL-15 by a variable length linker (termed "scIL-15/Rα") which is then fused to the N-terminus of a heterodimeric Fc-region (inclusive of the hinge). The second monomer is a heavy chain, VH-CH1-hinge-CH2-CH3, while a corresponding light chain (the third monomer) is transfected separately so as to form a Fab with the VH.

In the FIG. 28C format, some embodiments include an Fc domain with a positive monomer comprising the skew variants S364K/E357Q, the ablation variants E233P/L234V/L235A/G236del/S267K, the 428L/434S FcRn variants, and the negative monomer comprising the skew variants L368D/K370S, the ablation variants E233P/L234V/L235A/G236del/S267K, the pI variants N208D/Q295E/N384D/Q418E/N421D and the 428L/434S FcRn variant. In these embodiments, the sushi domain is the wild type (SEQ ID NO:4), and the anti-PD-1 Fv domain comprises a VH that comprises an F32L amino acid substitution as compared to SEQ ID NO:5 and a VL that comprises the amino acid substitutions N27dH/K30Y/S93T as compared to SEQ ID NO:6.

In the FIG. 28C format, some embodiments include an Fc domain with a positive monomer comprising the skew variants S364K/E357Q and the ablation variants E233P/L234V/L235A/G236del/S267K, and the negative monomer comprising the skew variants L368D/K370S, the ablation variants E233P/L234V/L235A/G236del/S267K and the pI variants N208D/Q295E/N384D/Q418E/N421D. In these embodiments, the sushi domain is the wild type (SEQ ID NO:4), the anti-PD-1 Fv domain comprises a VH that comprises an F32L amino acid substitution as compared to SEQ ID NO:5 and a VL that comprises the amino acid substitutions N27dH/K30Y/S93T as compared to SEQ ID NO:6, and the IL-15 domain comprises a variant selected from N4D/N65D, D30N/N65D and D30N/E64Q/N65D.

In the FIG. 28C format, some embodiments include an Fc domain with a positive monomer comprising the skew variants S364K/E357Q, the ablation variants E233P/L234V/L235A/G236del/S267K the 428L/434S FcRn variant, and the negative monomer comprising the skew variants L368D/K370S, the ablation variants E233P/L234V/L235A/G236del/S267K and the pI variants N208D/Q295E/N384D/Q418E/N421D and the 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28C format, some embodiments include an Fc domain with a positive monomer comprising the skew variants S364K/E357Q, the ablation variants E233P/L234V/ L235A/G236del/S267K the 428L/434S FcRn variant, and the negative monomer comprising the skew variants L368D/ K370S, the ablation variants E233P/L234V/L235A/ G236del/S267K and the pI variants N208D/Q295E/N384D/ Q418E/N421D and the 428L/434S FcRn variant. In these embodiments, the sushi domain is the wild type (SEQ ID NO:4), and the anti-PD-1 Fv domain is the VH and VL domain combination of H1_L1.1 and the IL-15 domain comprises a variant selected from N4D/N65D, D30N/N65D and D30N/E64Q/N65D.

In the FIG. 28C format, some embodiments include an Fc domain with a positive monomer comprising the skew variants S364K/E357Q and the ablation variants E233P/ L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28C format, some aspects include an Fc domain with a positive monomer comprising the skew variants S364K/E357Q and the ablation variants E233P/ L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/ N65D, D30N/N65D and D30N/E64Q/N65D.

Amino acid sequences of illustrative non-competing PD-1 targeted IL-15/Rα-Fc fusion protein of the scIL-15/Rα×Fab format (FIG. 28C) are provided in FIGS. 30, 48, 49 and 68.

In some embodiments, the first monomer comprises, from N- to C-terminus, the sushi domain-domain linker-variant IL-15-domain linker-CH2-CH3 and the second monomer comprises a heavy chain, VH-CH1-hinge-CH2-CH3. The third monomer is a light chain, VL-CL. Preferred combinations of variants for this embodiment are found in FIG. 7C of PCT/US2017/056826.

In the scIL-15/Rα×Fab format, one preferred embodiment utilizes the skew variant pair S364K/E357Q:L368D/ K370S.

In the scIL-15/Rα×Fab format, one preferred embodiment utilizes the skew variants S364K/E357Q (on the scFv-Fc monomer) and L368D/K370S (on the IL-15 complex monomer), the pI variants Q295E/N384D/Q418E/N421D (on the IL-15 complex side), the ablation variants E233P/ L234V/L235A/G236_/S267K on both monomers, and optionally the 428L/434S variants on both sides.

D. ncIL-15/Rα×Fab

This embodiment is shown in FIG. 28D, and comprises three monomers. This is generally referred to as "ncIL-15/ Rα×Fab" or "Fab×ncIL-15/Rα," as used interchangeably, with the "nc" standing for "non-covalent" referring to the self-assembing non-covalent attachment of the IL-15 and sushi domain. The ncIL-15/Rα×Fab format (see FIG. 34D) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed.

In some embodiments, the first monomer comprises, from N- to C-terminus, the sushi domain-domain linker-CH2-CH3, and the second monomer comprises a heavy chain, VH-CH1-hinge-CH2-CH3. The third monomer is the IL-15 domain. In the ncIL-15/Rα×Fab format, one preferred embodiment utilizes the skew variant pair S364K/E357Q: L368D/K370S.

In the FIG. 28D format, some aspects include an Fc domain with a positive monomer comprising the skew variants S364K/E357Q and the ablation variants E233P/ L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/ N65D.

In the FIG. 28D format, some aspects include an Fc domain with a positive monomer comprising the skew variants S364K/E357Q and the ablation variants E233P/ L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/ N65D, D30N/N65D and D30N/E64Q/N65D.

E. mAb-scIL-15/Rα

This embodiment is shown in FIG. 28E, and comprises three monomers (although the fusion protein is a tetramer). This is generally referred to as "mAb-scIL-15/Rα", with the "sc" standing for "single chain". The mAb-scIL-15/Rα format (see FIG. 34E) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form Fabs with the VHs.

In some embodiments, the first monomer comprises a heavy chain, VH-CH1-hinge-CH2-CH3. The second monomer comprises a heavy chain with a scIL-15 complex, VH-CH1-hinge-CH2-CH3-domain linker-sushi domain-domain linker-IL-15. The third (and fourth) monomer are light chains, VL-CL. This is generally referred to as "mAb-scIL-15/Rα", with the "sc" standing for "single chain". In the mAb-scIL-15/Rα format, one preferred embodiment utilizes the skew variant pair S364K/E357Q:L368D/K370S.

In the FIG. 28E format, some aspects include an Fc domain with a positive monomer comprising the skew variants S364K/E357Q and the ablation variants E233P/ L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28E format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/N65D, D30N/N65D and D30N/E64Q/N65D.

F. mAb-ncIL-15/Rα

Figure 28F:
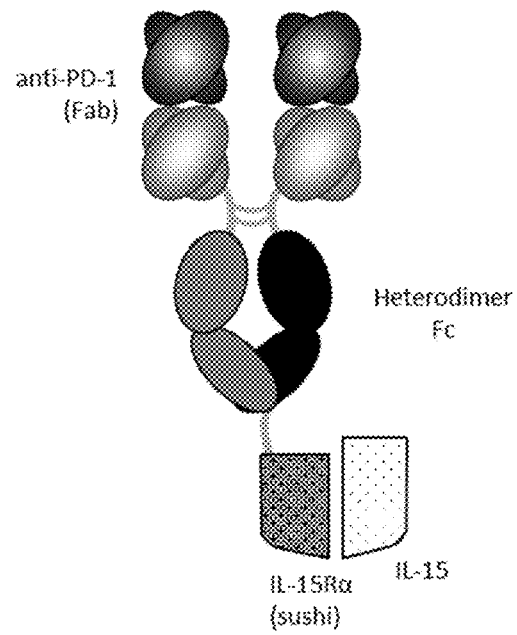

This embodiment is shown in FIG. 28F and comprises four monomers (although the heterodimeric fusion protein is a pentamer). This is generally referred to as "mAb-ncIL-15/Rα", with the "nc" standing for "non-covalent". The mAb-ncIL-15/Rα format (FIGS. 34A-34B) comprises VH fused to the N-terminus of a first and a second heterodimeric Fc, with IL-15Rα(sushi) fused to the C-terminus of one of the heterodimeric Fc-region, while corresponding light chains are transfected separately so as to form Fabs with the VHs, and while IL-15 is transfected separately so that a non-covalent IL-15/Rα complex is formed.

In some embodiments, the first monomer comprises a heavy chain, VH-CH1-hinge-CH2-CH3. The second monomer comprises a heavy chain with an IL-15Rα(sushi) domain, VH-CH1-hinge-CH2-CH3-domain linker-sushi domain. The third monomer is an IL-15 domain. The fourth (and fifth) monomer are light chains, VL-CL. In the mAb-ncIL-15/Rα format, one preferred embodiment utilizes the skew variant pair S364K/E357Q:L368D/K370S.

In the FIG. 28F format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28F format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/N65D, D30N/N65D and D30N/E64Q/N65D.

G. Central-IL-15/Rα

Figure 28G:
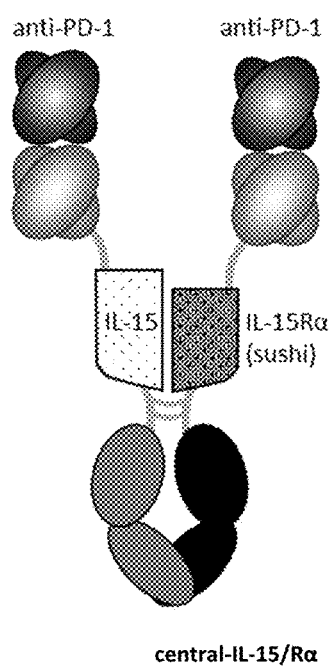

This embodiment is shown in FIG. 28G, and comprises four monomers forming a tetramer. This is generally referred to as "Central-IL-15/Rα". The central-IL-15/Rα format (see FIG. 28G) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs.

In the FIG. 28G format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28G format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1_L1.1 and the IL-15 domain comprises a variant selected from N4D/N65D, D30N/N65D and D30N/E64Q/N65D.

H. Central scIL-15/Rα

Figure 28H:
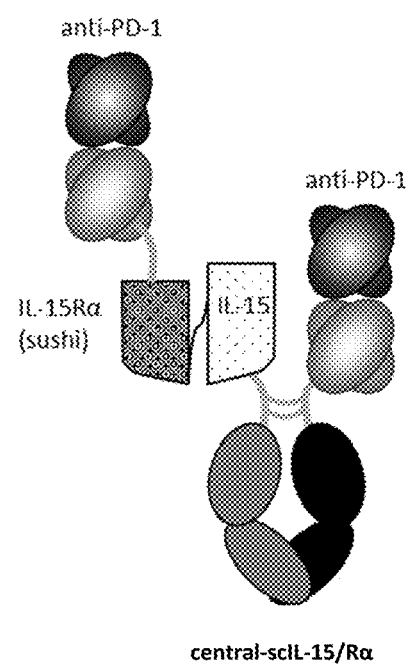

This embodiment is shown in FIG. 28H, and comprises four monomers forming a tetramer. This is generally referred to as "central-scIL-15/Rα", with the "sc" standing for "single chain". The central-scIL-15/Rα format (see FIG. 34A-34B) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs.

In the FIG. 28H format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is the VH and VL domain combination of H1.19_L1.140 and the IL-15 domain comprises a variant selected from N4D/N65D, D30N/N65D and D30N/E64Q/N65D.

In the FIG. 28H format, some aspects include an Fc domain with a positive monomer comprising the skew variants S364K/E357Q and the ablation variants E233P/L234V/L235A/G236del/S267K and the negative monomer comprising the skew variants L368D/K370S, the ablation variants E233P/L234V/L235A/G236del/S267K and the pI variants N208D/Q295E/N384D/Q418E/N421D and optionally a 428L/434S FcRn variant. In these embodiments, the sushi domain is the wild type (SEQ ID NO:4), and the anti-PD-1 Fv domain is selected from the group consisting of the VH and VL domain combinations of H1.19_L1.140 and the IL-15 domain comprises a variant selected from N4D/N65D, D30N/N65D and D30N/E64Q/N65D.

I. Additional Formats

As will be appreciated by those in the art, there are additional formats that find use with the IL-15 complexes and non-competing anti-PD-1 Fv sequences. Thus, for example, the invention provides fusion proteins that comprise an IL-15 complex comprising an IL-15 domain (which can be wild-type or a variant), a domain linker, an IL-15R sequence (which can be all or part of the extracellular domain and may also include variants) and a non-competing anti-PD-1 ABD, whether as a Fab or a scFv.

V. Useful Embodiments of the Invention

Provided herein are PD-1 targeted IL-15/Rα-Fc fusion proteins with one or more engineered amino acid substitutions of the IL-15 protein and anti-PD-1 ABDs that do not compete for binding with selected approved anti-PD-1 antibodies. In some embodiments, the IL-15 variant of the Fc fusion protein has N4D/N65D substititutions. In some embodiments, the IL-15 variant of the Fc fusion protein has a D30N substititution. In some embodiments, the IL-15 variant of the Fc fusion protein has D30N/E64Q/N65D substititutions. In some embodiments, the IL-15 variant of the Fc fusion protein has D30N/N65D substititutions. Such IL-15/Rα-Fc containing fusion proteins can induce or promote proliferation of immune cells including NK cells, CD8⁺ T cells, and CD4⁺ T cells. Notably, IL-15/Rα-Fc containing fusion proteins that have no linker (e.g., hinge region only) on the IL-15 Fc side demonstrated weaker proliferative activity.

Provided herein are PD-1 targeted IL-15/Rα-Fc fusion proteins with lower potency, increased pharmacokinetics, and/or increased serum half-life. The PD-1 targeted IL-15/Rα-Fc fusion proteins described herein were engineered to decrease their potency compared to a parental construct. In some embodiments, one or more amino acid substitutions were introduced into the IL-15/Rα complex and/or in the Fc domain(s) of the heterodimeric Fc fusion protein. In some embodiments, PD-1 targeted IL-15/Rα-Fc fusion proteins with reduced potency compared to a control construct (e.g., a parental construct) have a substantially longer serum half-like. In certain embodiments, the serum half-life increased by 1×, 2×, 3×, 4×, 5×, 6×, 7×, 8×, 9×, 10×, 15×, 20×, 25× or more.

Provided herein are PD-1 targeted IL-15/Rα-Fc fusion proteins that enhanced GVHD in an animal model (e.g., a human PBMC-engrafted NSG mice) compared to the combination therapy of a control scIL-15/Rα-Fc fusion protein engineered for reduced potency and an anti-PD-1 antibody. Administration of an exemplary non-competing PD-1 targeted IL-15/Rα-Fc fusion protein produced a greater effect compared to the combination of IL-15 and PD-1 blockade.

The PD-1 targeted IL-15/Rα-Fc fusion proteins described herein including the non-competing PD-1 targeted IL-15/Rα-Fc fusion proteins can induce STAT5 phosphorylation in immune cells including, but not limited to activated lymphocytes, activated T cells (e.g., activated CD4+ T cells and activated CD8+ cells), and activated tumor infiltrating lymphocytes (e.g., activated TILs).

A preferred embodiment utilizes the FIG. 28C format. This embodiment includes: a) an Fc domain with (i) a positive monomer comprising the skew variants S364K/E357Q, the ablation variants E233P/L234V/L235A/G236del/S267K and the 428L/434S FcRn variants; b), and (ii) a negative monomer comprising the skew variants L368D/K370S, the ablation variants E233P/L234V/L235A/G236del/S267K, the pI variants N208D/Q295E/N384D/Q418E/N421D and the 428L/434S FcRn variant; b) the sushi domain is the wild type (SEQ ID NO:4); c) the anti-PD-1 Fv domain comprises a VH that comprises an F32L amino acid substitution as compared to SEQ ID NO:5 and a VL that comprises the amino acid substitutions N27dH/K30Y/S93T as compared to SEQ ID NO:6; and d) the IL-15 domain is D30N/E64Q/N65D.

An additional preferred embodiment utilizes the FIG. 28C format. This embodiment includes: a) an Fc domain with (i) a positive monomer comprising the skew variants S364K/E357Q, the ablation variants E233P/L234V/L235A/G236del/S267K and the 428L/434S FcRn variant; (ii) the negative monomer comprising the skew variants L368D/K370S, the ablation variants E233P/L234V/L235A/G236del/S267K, the pI variants N208D/Q295E/N384D/Q418E/N421D and the 428L/434S FcRn variant; b) the sushi domain is the wild type (SEQ ID NO:4); c) the anti-PD-1 Fv domain is the VH and VL domain combination of H1_L1.1 and d) the IL-15 domain comprises D30N/E64Q/N65D.

In some embodiments, particularly useful sequences for the fusion proteins of the invention are based on FIG. 11 backbone sequences for the FIGS. 34A-34B format. These are sequences for two monomers, the "IL-15 complex side" and the "Fab side", without the IL-15 complex sequences nor the VH of the Fab (the light chain constant region sequences are in FIG. 12).

That is, the invention provides Backbone 1 sequences in combination with a VH and VL sequence from FIG. 43.

VI. Nucleic Acids of the Invention

The invention further provides nucleic acid compositions encoding the heterodimeric Fc fusion proteins of the invention (or, in the case of a monomer Fc domain protein, nucleic acids encoding those as well).

As will be appreciated by those in the art, the nucleic acid compositions will depend on the format of the heterodimeric IL-15/Rα Fc fusion protein. Thus, for example, when the format requires three amino acid sequences, three nucleic acid sequences can be incorporated into one or more expression vectors for expression. Similarly, some formats only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric Fc fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids are contained on a different expression vector.

The heterodimeric Fc fusion protein of the invention are made by culturing host cells comprising the expression vector(s) as is well known in the art. Once produced, traditional fusion protein or antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the heterodimer (e.g., anionic exchange columns, cationic exchange columns). These substitutions also aid in the determination and monitoring of any contaminating homodimers post-purification (e.g., IEF gels, cIEF, and analytical IEX columns).

VII. Biological and Biochemical Functionality of Bispecific Immune Checkpoint Antibody×IL-15/IL-15Rα Heterodimeric Immunomodulatory Fusion Proteins Generally, the Fc fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+CD4+ T cells following ipi treatment) along with "old fashioned" measurements such as tumor burden, size, invasiveness, LN involvement, metastasis, etc. can be done. Thus, any or all of the following can be evaluated: the inhibitory effects of the fusion proteins on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of the fusion proteins on Treg cell differentiation and proliferation and Treg- or myeloid derived suppressor cell (MDSC)-mediated immunosuppression or immune tolerance, and/or the effects of the fusion proteins on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation methods.

In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure for Competitive Binding

In general, epitope binning assays such as those described herein, as well as other competitive inhibition assays such as are known in the art, can be run to determine whether the NCPD-1 Fv will compete for binding to PD-1 with approved antibodies. Epitope binning is a process that uses a competitive immunoassay to test antibodies in a pairwise combinatorial manner, and antibodies that compete for the same binding region, that is, the same or a closely related epitope of an antigen, are grouped together into bins. Therefore, an antibody that bins to a different epitope from nivolumab and/or pembrolizumab is considered to be non-competing with nivolumab and/or pembrolizumab.

Non-competing antibodies may be determined by an assay in which the antibody or immunologically functional fragment being tested does not prevent or inhibit specific binding of a reference antibody to a common antigen. Typically, such an assay involves the use of purified antigen (e.g., PD-1 or a domain or fragment thereof) bound to a solid surface or cells. Competitive inhibition is measured by determining the amount of a first antibody bound to the solid surface or cells in the presence of the second antibody. Usually, when a competing antibody is present in excess, it will inhibit specific binding of a reference antibody to a common antigen by at least 30%, 40%, 45%, 50%, 55%, 60%, 65%, 70% or 75%. In some instance, binding is inhibited by at least 80%, 85%, 90%, 95%, or 97% or more. Conversely, when the reference antibody is bound it will preferably inhibit binding of a subsequently added test antibody (i.e., a PD-1 antibody) by at least 30%, 40%, 45%, 50%, 55%, 60%, 65%, 70% or 75%. In some instance, binding of the test antibody is inhibited by at least 80%, 85%, 90%, 95%, or 97% or more.

Generally binning or competitive binding may be determined using various art-recognized techniques, such as, for example, immunoassays such as western blots, radioimmunoassays, enzyme linked immunosorbent assay (ELISA), "sandwich" immunoassays, immunoprecipitation assays, precipitin reactions, gel diffusion precipitin reactions, immunodiffusion assays, agglutination assays, complementfixation assays, immunoradiometric assays, fluorescent immunoassays and protein A immunoassays. Such immunoassays are routine and well known in the art (see, Ausubel et al, eds, (1994) Current Protocols in Molecular Biology, Vol. 1, John Wiley & Sons, Inc., New York). Additionally, cross-blocking assays may be used (see, for example, WO 2003/48731; and Harlow et al. (1988) Antibodies, A Laboratory Manual, Cold Spring Harbor Laboratory, Ed Harlow and David Lane).

Other technologies used to determine competitive inhibition (and hence "bins"), include: surface plasmon resonance using, for example, the BIAcore™ 2000 system (GE Healthcare); bio-layer interferometry using, for example, a ForteBio® Octet RED (ForteBio); or flow cytometry bead arrays using, for example, a FACSCanto II (BD Biosciences) or a multiplex LUMINEX™ detection assay (Luminex). One particular method for determining competitive binding using bio-layer interferometry is provided in Examples 2 and 7 herein.

Luminex is a bead-based immunoassay platform that enables large scale multiplexed antibody pairing. The assay compares the simultaneous binding patterns of antibody pairs to the target antigen. One antibody of the pair (capture mAb) is bound to Luminex beads, wherein each capture mAb is bound to a bead of a different color. The other antibody (detector mAb) is bound to a fluorescent signal (e.g. phycoerythrin (PE)). The assay analyzes the simultaneous binding (pairing) of antibodies to an antigen and groups together antibodies with similar pairing profiles. Similar profiles of a detector mAb and a capture mAb indicates that the two antibodies bind to the same or closely related epitopes. In one embodiment, pairing profiles can be determined using Pearson correlation coefficients to identify the antibodies which most closely correlate to any particular antibody on the panel of antibodies that are tested. In embodiments a test/detector mAb will be determined to be in the same bin as a reference/capture mAb if the Pearson's correlation coefficient of the antibody pair is at least 0.9. In other embodiments the Pearson's correlation coefficient is at least 0.8, 0.85, 0.87 or 0.89. In further embodiments, the Pearson's correlation coefficient is at least 0.91, 0.92, 0.93, 0.94, 0.95, 0.96, 0.97, 0.98, 0.99 or 1. Other methods of analyzing the data obtained from the Luminex assay are described in U.S. Pat. No. 8,568,992. The ability of Luminex to analyze 100 different types of beads (or more) simultaneously provides almost unlimited antigen and/or antibody surfaces, resulting in improved throughput and resolution in antibody epitope profiling over a biosensor assay (Miller, et al., 2011, PMID: 21223970).

Similarly binning techniques comprising surface plasmon resonance are compatible with the instant invention. As used herein "surface plasmon resonance," refers to an optical phenomenon that allows for the analysis of real-time specific interactions by detection of alterations in protein concentrations within a biosensor matrix. Using commercially available equipment such as the BIAcore™ 2000 system it may readily be determined if selected antibodies compete with each other for binding to a defined antigen.

In other embodiments, a technique that can be used to determine whether a test antibody "competes" for binding with a reference antibody is "bio-layer interferometry", an optical analytical technique that analyzes the interference pattern of white light reflected from two surfaces: a layer of immobilized protein on a biosensor tip, and an internal reference layer. Any change in the number of molecules bound to the biosensor tip causes a shift in the interference pattern that can be measured in real-time. Such biolayer interferometry assays may be conducted using a ForteBio® Octet RED machine as follows. A reference antibody (Ab1) is captured onto an anti-mouse capture chip, a high concentration of non-binding antibody is then used to block the chip and a baseline is collected. Monomeric, recombinant target protein is then captured by the specific antibody (Ab1) and the tip is dipped into a well with either the same antibody (Ab1) as a control or into a well with a different test antibody (Ab2). If no further binding occurs, as determined by comparing binding levels with the control Ab1, then Ab1 and Ab2 are determined to be "competing" antibodies. If additional binding is observed with Ab2, then Ab1 and Ab2 are determined not to compete with each other. This process can be expanded to screen large libraries of unique antibodies using a full row of antibodies in a 96-well plate representing unique bins. In embodiments a test antibody will compete with a reference antibody if the reference antibody inhibits specific binding of the test antibody to a common antigen by at least 40%, 45%, 50%, 55%, 60%, 65%, 70% or 75%. In other embodiments, binding is inhibited by at least 80%, 85%, 90%, 95%, or 97% or more.

B. Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of $\alpha\beta$ and/or $\gamma\delta$ T cells as measured for an example by cytokine secretion or by proliferation or by changes in expression of activation markers like for an example CD25, CD69, CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD25, CD69, CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in $\alpha\beta$ and/or $\gamma\delta$ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFNγ, TNF-a, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Similarly, increases of at least one-, two-, three-, four- or five-fold as compared to reference or control samples show efficacy.

VIII. Checkpoint Blockade Antibodies

The PD-1 targeted IL-15/Rα-Fc fusion proteins of the invention described herein are combined with other therapeutic agents including checkpoint blockade antibodies, such as but not limited to, a PD-1 inhibitor, a TIM3 inhibitor, a CTLA4 inhibitor, a PD-L1 inhibitor, a TIGIT inhibitor, a LAG3 inhibitor, or a combination thereof.

In addition to the antibodies discussed below, additional disclosure is found in U.S. Ser. No. 62/784,334, incorporated by reference in its entirety and specifically for the discussion of checkpoint antibodies for use in combination.

A. Anti-PD1 Antibodies

In some embodiments, a PD-1 targeted IL-15/Rα-Fc fusion protein described herein can be administered to a subject with cancer in combination with a checkpoint blockage antibody, e.g., an anti-PD-1 antibody or an anti-PD-L1 antibody.

In many aspects, the PD-1 inhibitor is an anti-PD-1 antibody chosen from those that do not compete for binding with the anti-PD-1 non-competing Fv sequences outlined herein. Of particular use are those anti-PD-1 antibodies approved for use in humans in the US or overseas including, but not limited to, nivolumab and pembrolizumab.

In some embodiments, the anti-PD-1 antibody is nivolumab. Alternative names for nivolumab include MDX-1106, MDX-1106-04, ONO-4538, or BMS-936558. In some embodiments, the anti-PD-1 antibody is nivolumab (CAS Registry Number: 946414-94-4). Nivolumab is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. In one embodiment, the inhibitor of PD-1 is nivolumab, and having a sequence disclosed herein (or a sequence substantially identical or similar thereto, e.g., a sequence at least 85%, 90%, 95% identical or higher to the sequence specified).

In some embodiments, the anti-PD-1 antibody is pembrolizumab. Pembrolizumab (also referred to as lambrolizumab, MK-3475, MK03475, SCH-900475 or KEYTRUDA®; Merck) is a humanized IgG4 monoclonal antibody that binds to PD-1. Pembrolizumab and other humanized anti-PD-1 antibodies are disclosed in Hamid, O. et al. (2013) *New England Journal of Medicine* 369 (2): 134-44, U.S. Pat. No. 8,354,509 and WO2009/114335.

Other anti-PD1 antibodies include AMP 514 (Amplimmune), among others, e.g., anti-PD1 antibodies disclosed in U.S. Pat. No. 8,609,089, US 2010028330, and/or US 20120114649.

In some embodiments, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In some embodiments, the PD-1 inhibitor is AMP-224 (B7-DCIg; Amplimmune; e.g., disclosed in WO2010/027827 and WO2011/066342), is a PD-L2 Fc fusion soluble receptor that blocks the interaction between PD-1 and B7-H1.

In some embodiments, anti-PD-1 antibodies can be used in combination with an IL-15/Rα×anti-PD1 heterodimeric Fc fusion protein of the invention. There are several anti-PD-1 antibodies including, but not limited to, two currently FDA approved antibodies, pembrolizumab and nivolizumab, as well as those in clinical testing currently, including, but not limited to, tislelizumab, Sym021, REGN2810 (developed by Rengeneron), JNJ-63723283 (developed by J and J), SHR-1210, pidilizumab, AMP-224, MEDIo680, PDR001 and CT-001, as well as others outlined in Liu et al., J. Hemat. & Oncol. (2017)10:136, the antibodies therein expressly incorporated by reference.

B. Anti-TIM3 Antibodies

The IL-15/Rα×[NC]PD-1 heterodimeric fusion proteins of the invention can also be co-administered with anti-TIM-3 antibodies. Exemplary non-limiting anti-TIM-3 antibody molecules are disclosed in US 2015/0218274, published on Aug. 6, 2015, entitled "Antibody Molecules to TIM-3 and Uses Thereof," incorporated by reference in its entirety.

There are several TIM-3 antibodies in clinical development, including, but not limited to, MBG453, Sym023, BGB-A425, and TSR-022.

In one embodiment, the anti-TIM-3 antibody molecule includes at least one or two heavy chain variable domain (optionally including a constant region), at least one or two light chain variable domain (optionally including a constant region), or both, comprising the amino acid sequence of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3- hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences. The anti-TIM-3 antibody molecule, optionally, comprises a leader sequence from a heavy chain, a light chain, or both, as shown in US 2015/0218274; or a sequence substantially identical thereto.

In yet another embodiment, the anti-TIM-3 antibody molecule includes at least one, two, or three complementarity determining regions (CDRs) from a heavy chain variable region and/or a light chain variable region of an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In yet another embodiment, the anti-TIM-3 antibody molecule includes at least one, two, or three CDRs (or collectively all of the CDRs) from a heavy chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Table 1-4.

In yet another embodiment, the anti-TIM-3 antibody molecule includes at least one, two, or three CDRs (or collectively all of the CDRs) from a light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4. In certain embodiments, the anti-TIM-3 antibody molecule includes a substitution in a light chain CDR, e.g., one or more substitutions in a CDR1, CDR2 and/or CDR3 of the light chain.

In another embodiment, the anti-TIM-3 antibody molecule includes at least one, two, three, four, five or six CDRs (or collectively all of the CDRs) from a heavy and light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4.

C. Anti-CTLA4 Antibodies

The IL-15/Rα×[NC]PD-1 heterodimeric fusion proteins of the invention can also be co-administered with anti-CTLA-4 antibodies. Suitable anti-CTLA-4 antibodies for use in combination therapies as outlined herein include, but are not limited to, one currently FDA approved antibody ipilimumab, and several more in development, including CP-675,206 and AGEN-1884. Additional exemplary anti-CTLA4 antibodies include tremelimumab (IgG2 monoclonal antibody available from Pfizer, formerly known as ticilimumab, CP-675,206); and dim (CTLA-4 antibody, also known as MDX-010, CAS No. 477202-00-9). Other exemplary anti-CTLA-4 antibodies are disclosed, e.g., in U.S. Pat. No. 5,811,097.

In one embodiment, the anti-CTLA4 antibody is ipilimumab disclosed in, e.g., U.S. Pat. Nos. 5,811,097, 7,605,238, WO00/32231 and WO97/20574, and having a sequence disclosed herein (or a sequence substantially identical or similar thereto, e.g., a sequence at least 85%, 90%, 95% identical or higher to the sequence specified).

In one embodiment, the anti-CTLA4 antibody is tremelimumab disclosed in, e.g., U.S. Pat. No. 6,682,736 and WO00/37504, and having a sequence disclosed herein (or a sequence substantially identical or similar thereto, e.g., a sequence at least 85%, 90%, 95% identical or higher to the sequence specified).

D. Anti-PD-L1 Antibodies

The IL-15/Rα×[NC]PD-1 heterodimeric fusion proteins of the invention can also be co-administered with anti-PD-L1 antibodies. Exemplary non-limiting anti-PD-L1 antibody molecules are disclosed in US 2016/0108123, published on Apr. 21, 2016, entitled "Antibody Molecules to PD-L1 and Uses Thereof," incorporated by reference in its entirety.

In one embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-0; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three complementarity determining regions (CDRs) from a heavy chain variable region and/or a light chain variable region of an antibody described herein, e.g., an antibody chosen from any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-0; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In some embodiments, the PD-L1 inhibitor is an antibody molecule. In some embodiments, the anti-PD-L1 inhibitor is chosen from YW243.55.S70, MPDL3280A, MEDI-4736, MSB-0010718C, MDX-1105, atezolizumab, durbalumab, avelumab, or BMS936559.

In some embodiments, the anti-PD-L1 antibody is atezolizumab. Atezolizumab (also referred to as MPDL3280A and Atezo®; Roche) is a monoclonal antibody that binds to PD-L1. Atezolizumab and other humanized anti-PD-L1 antibodies are disclosed in U.S. Pat. No. 8,217,149, and having a sequence disclosed herein (or a sequence substantially identical or similar thereto, e.g., a sequence at least 85%, 90%, 95% identical or higher to the sequence specified).

In some embodiments, the anti-PD-L1 antibody is avelumab. Avelumab (also referred to as A09-246-2; Merck Serono) is a monoclonal antibody that binds to PD-L1. Avelumab and other humanized anti-PD-L1 antibodies are disclosed in U.S. Pat. No. 9,324,298 and WO2013/079174, and having a sequence disclosed herein (or a sequence substantially identical or similar thereto, e.g., a sequence at least 85%, 90%, 95% identical or higher to the sequence specified).

In some embodiments, the anti-PD-L1 antibody is durvalumab. Durvalumab (also referred to as MEDI4736; AstraZeneca) is a monoclonal antibody that binds to PD-L1. Durvalumab and other humanized anti-PD-L1 antibodies are disclosed in U.S. Pat. No. 8,779,108, and having a sequence disclosed herein (or a sequence substantially identical or similar thereto, e.g., a sequence at least 85%, 90%, 95% identical or higher to the sequence specified).

In some embodiments, the anti-PD-L1 antibody is BMS-936559. BMS-936559 (also referred to as MDX-1105; BMS) is a monoclonal antibody that binds to PD-L1. BMS-936559 and other humanized anti-PD-L1 antibodies are disclosed in U.S. Pat. No. 7,943,743 and WO2007005874, and having a sequence disclosed herein (or a sequence substantially identical or similar thereto, e.g., a sequence at least 85%, 90%, 95% identical or higher to the sequence specified).

In some embodiments, anti-PD-L1 antibodies can be used in combination with an IL-15/Rα×anti-PD1 heterodimeric Fc fusion protein of the invention. There are several anti-PD-L1 antibodies including three currently FDA approved antibodies, atezolizumab, avelumab, durvalumab, as well as those in clinical testing currently, including, but not limited to, LY33000054 and CS1001, as well as others outlined in Liu et al., J. Hemat. & Oncol. (2017)10:136, the antibodies therein expressly incorporated by reference.

In some embodiments, a PD-1 targeted IL-15/Rα-Fc fusion protein described herein can be used in combination with a PD-L1 or PD-L2 inhibitor (e.g., an anti-PD-L1 antibody).

E. Anti-TIGIT Antibodies

The IL-15/Rα×[NC]PD-1 heterodimeric fusion proteins of the invention can also be co-administered with anti-TIGIT antibodies. In some embodiments, the anti-TIGIT antibody is OMP-313M32. OMP-313M32 (OncoMed Pharmaceuticals) is a monoclonal antibody that binds to TIGIT. OMP-313M32 and other humanized anti-TIGIT antibodies are disclosed in US20160376365 and WO2016191643, and having a sequence disclosed herein (or a sequence substantially identical or similar thereto, e.g., a sequence at least 85%, 90%, 95% identical or higher to the sequence specified).

In some embodiments, the anti-TIGIT antibody is BMS-986207. BMS-986207 (also referred to as ONO-4686; Bristol-Myers Squibb) is a monoclonal antibody that binds to TIGIT. BMS-986207 and other humanized anti-TIGIT antibodies are disclosed in US20160176963 and WO2016106302, and having a sequence disclosed herein (or a sequence substantially identical or similar thereto, e.g., a sequence at least 85%, 90%, 95% identical or higher to the sequence specified).

In some embodiments, the anti-TIGIT antibody is MTIG7192. MTIG7192 (Genentech) is a monoclonal antibody that binds to TIGIT. MTIG7192 and other humanized anti-TIGIT antibodies are disclosed in US2017088613, WO2017053748, and WO2016011264, and having a sequence disclosed herein (or a sequence substantially identical or similar thereto, e.g., a sequence at least 85%, 90%, 95% identical or higher to the sequence specified).

In some embodiments, anti-TIGIT antibodies can be used in combination with an IL-15/Rα×anti-PD1 heterodimeric Fc protein of the invention. There are several TIGIT antibodies in clinical development, BMS-986207, OMP-313M32 and MTIG7192A.

F. Anti-LAG-3 Antibodies

The IL-15/Rα×[NC]PD-1 heterodimeric fusion proteins of the invention can also be co-administered with anti-LAG-3 antibodies. Exemplary non-limiting anti-LAG-3 antibody molecules are disclosed in US 2015/0259420 published on Sep. 17, 2015, entitled "Antibody Molecules to LAG-3 and Uses Thereof," incorporated by reference in its entirety.

In one embodiment, the anti-LAG-3 antibody molecule includes at least one or two heavy chain variable domain (optionally including a constant region), at least one or two light chain variable domain (optionally including a constant region), or both, comprising the amino acid sequence of any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three complementarity determining regions (CDRs) from a heavy chain variable region and/or a light chain variable region of an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In some embodiments, the anti-LAG-3 antibody is BMS-986016. BMS-986016 (also referred to as BMS986016; Bristol-Myers Squibb) is a monoclonal antibody that binds to LAG-3. BMS-986016 and other humanized anti-LAG-3 antibodies are disclosed in US 2011/0150892, WO2010/019570, and WO2014/008218.

In some embodiments, the anti-LAG3 antibody is LAG525. LAG525 (also referred to as IMP701; Novartis) is a monoclonal antibody that binds to LAG3. LAG525 and other humanized anti-LAG3 antibodies are disclosed in U.S. Pat. No. 9,244,059 and WO2008132601, and having a sequence disclosed herein (or a sequence substantially identical or similar thereto, e.g., a sequence at least 85%, 90%, 95% identical or higher to the sequence specified).

Other exemplary anti-LAG-3 antibodies are disclosed, e.g., in US2011150892 and US2018066054.

In some embodiments, anti-LAG-3 antibodies can be used in combination with an IL-15/Rαxanti-PD1 bifunctional heterodimeric fusion protein of the invention. There are several anti-LAG-3 antibodies in clinical development including REGN3767, by Regeneron and TSR-033 (Tesaro).

IX. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the heterodimeric Fc protein compositions of the invention find use in the treatment of these cancers.

A. Administration

In this context, administration "in combination", as used herein, means that the two treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive.

The delivery can be such that an effect of the first treatment delivered is still detectable when the second is delivered.

B. Formulations for In Vivo Administration

Formulations of the antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Administrative Modalities The PD-1 targeted IL-15/Rα-Fc fusion proteins disclosed herein and chemotherapeutic agents of the invention are administered to a subject, in accord with known methods, such as intravenous administration as a bolus or by continuous infusion over a period of time.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

X. Examples

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein. Examples 1 and 2 from U.S. Ser. No. 62/416,087, filed on Nov. 1, 2016 are expressly incorporated by reference in their entirety, including the corresponding figures.

A. Example 1: IL-15/Rα-Fc

1. Engineering IL-15/Rα-Fc Fusion Proteins

In order to address the short half-life of IL-15/IL-15Rα heterodimers, we generated the IL-15/IL-15Rα(sushi) complex as an Fc fusion (herein, collectively referred to as IL-15/Rα-Fc fusion proteins) with the goal of facilitating production and promoting FcRn-mediated recycling of the complex and prolonging half-life.

Plasmids coding for IL-15 or IL-15Rα sushi domain were constructed by standard gene synthesis, followed by subcloning into a pTT5 expression vector containing Fc fusion partners (e.g., constant regions as depicted in FIG. 10). Cartoon schematics of illustrative IL-15/Rα-Fc fusion protein formats are depicted in FIGS. 13A-G.

An illustrative protein of the IL-15/Rα-heteroFc format (FIG. 13A) is XENP20818, sequences for which are depicted in FIG. 14, with sequences for additional proteins of this format. An illustrative proteins of the scIL-15/Rα-Fc format (FIG. 13B) is XENP21478, sequences for which are depicted in FIG. 15. An illustrative proteins of the ncIL-15/Rα-Fc format (FIG. 13C) is XENP21479, sequences for which are depicted in FIG. 16.

Proteins were produced by transient transfection in HEK293E cells and were purified by a two-step purification process comprising protein A chromatography and ion exchange chromatography.

Illustrative IL-15/Rα-Fc fusion proteins in the scIL-15/Rα-Fc format (XENP21478) and in the ncIL-15/Rα-Fc format (XENP21479) were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cy5.5 (OKT4), anti-CD27-PE (M-T271), anti-CD56-BV421 (5.1H11), anti-CD16-BV421 (3G8), and anti-CD45RA-BV605 (Hi100) to gate for the following cell types: $CD4^+$ T cells, $CD8^+$ T cells, and NK cells (CD56+/CD16+). Ki67 is a protein strictly associated with cell proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 17A-C). The data show that the illustrative IL-15/Rα-Fc fusion proteins induced strong proliferation of $CD8^+$ T cells and NK cells.

2. IL-15/Rα-Fc Fusion Proteins Engineered for Lower Potency

In order to further improve PK and prolong half-life, we reasoned that decreasing the potency of IL-15/Rα-Fc fusions would decrease the antigen sink, and thus, increase circulating half-life. By examining the crystal structure of the IL-15:IL-2Rβ and IL-15:common gamma chain interfaces, as well as by modeling using MOE software, we predicted residues at these interfaces that may be substituted in order to reduce potency. FIG. 18 depicts a structural model of the IL-15:receptor complexes showing locations of the predicted residues where we engineered isosteric substitutions (in order to reduce the risk of immunogenicity). Sequences for illustrative IL-15 variants engineered with the aim to reduce potency are depicted in FIG. 19.

Plasmids coding for IL-15 or IL-15Rα(sushi) were constructed by standard gene synthesis, followed by subcloning into a pTT5 expression vector containing Fc fusion partners (e.g., constant regions as depicted in FIG. 10). Substitutions identified as described above were incorporated by standard mutagenesis techniques. Illustrative IL-15/Rα-Fc fusion proteins of the "scIL-15/Rα-Fc" format engineered for reduced potency include XENP29281, XENP24050, XENP29284, XENP29285, XENP29286, sequences for which are depicted in FIG. 21. Proteins were produced and purified as generally described in Example 1A.

a. In Vitro Activity of scIL-15/Rα-Fc Fusion Proteins Comprising IL-15 Variants Engineered for Decreased Potency Illustrative scIL-15/Rα-Fc fusion proteins comprising IL-15 variants were tested in cell proliferation assays. Human PBMCs were incubated with the indicated test articles at the indicated concentrations for 3 days. Following incubation, the PBMCs were stained with anti-CD3-PE (OKT3), anti-CD4-FITC (RPA-T4), anti-CD8-eF660 (SIDI8BEE), anti-CD16-BV421 (3G8), anti-CD45RA-APC/Fire750 (HI100), anti-CD56-BV605 (5.1H11), and anti-Ki67-PE/Cy7 (Ki-67) and analyzed by flow cytometry. FIG. 22 depicts the percentage of CD4 and CD8 T cell populations expressing Ki67 indicative of proliferation.

The data show that several of the illustrative scIL-15/Rα-Fc fusions comprising IL-15 variants engineered with the aim to reduce potency did demonstrate reduced potency relative to scIL-15/Rα-Fc fusions comprising WT IL-15. Notably, the data show that scIL-15/Rα-Fc fusions comprising IL-15(D30N/E64Q/N65D) variant had no activity or drastically reduced activity in proliferation of various lymphocyte populations in the context of scIL-15/Rα-Fc fusions, in comparison to scIL-15/Rα-Fc fusions comprising IL-15(N4D/N65D) or IL-15(D30N/N65D) variants. On the other hand, scIL-15/Rα-Fc fusion comprising IL-15(D30N) variant had little to no reduction in potency relative to scIL-15/Rα-Fc fusion comprising WT IL-15.

B. Example 2: PD-1 Targeting Arm

As described above, PD-1 expression is upregulated on activated tumor infiltrating lymphocytes. Accordingly, targeting IL-15/Rα-Fc fusions proteins of the invention to PD-1 expressing lymphocytes could be a useful approach for directing IL-15/Rα-Fc fusions to the tumor environment and avoiding systemic toxicity. Additionally, as it would be useful to combine the targeted IL-15/Rα-Fc fusion proteins of the invention with PD-1 blockade antibodies, or administer targeted IL-15/Rα-Fc fusion proteins of the invention subsequent to treatment with PD-1 blockade antibodies, it is important that the PD-1 targeting arm of the targeted IL-15/Rα-Fc fusion protein does not bind the same or similar epitope as the PD-1 blockade antibody. PD-1 blockade antibodies contemplated herein include, but are not limited to, nivolumab and pembrolizumab.

Sequences for several anti-PD-1 mAbs whose variable regions are contemplated for use herein are depicted in FIGS. 25-26. To investigate if the anti-PD-1 binding domains described above competed with nivolumab and pembrolizumab, we performed tandem epitope binning on the chimeric mAbs. Tandem epitope binning was performed using the Octet HTX instrument. HIS1K biosensors were first used to capture PD-1-His followed by dipping into 100 nM of a first antibody and then dipping into 100 nM of a second antibody. Antibodies tested were XENP16432 (a bivalent anti-PD-1 mAb based on nivolumab; sequence depicted in FIG. 24A), XENP21461 (pembrolizumab; sequence depicted in FIG. 24B, chimeric mAb A, chimeric mAb B, and a 1C11-based mAb. PD-L1-Fc was also included to investigate the blocking of PD-1:PD-L1 interaction by the antibodies. BLI-responses were normalized against the BLI-response of dipping the biosensor into HBS-EP buffer followed by dipping into the anti-PD-1 antibodies. If the antibody pair provided a normalized BLI-response less than 0.5, the pair was considered competing or partially competing and to be in the same epitope bin, i.e., recognizing very similar, or largely overlapping, epitopes. If the antibody pair provided a normalized BLI-response greater than 0.5, the pair was considered non-competing and to bin to different epitopes. The normalized BLI-response for each of the antibody pairs are summarized in FIG. 27.

The binning shows that anti-PD-1 mAb A and mAb B do not compete with nivolumab or pembrolizumab, while the 1C11-based mAb competed with both nivolumab and pembrolizumab. Additionally, mAb A does not appear to block the PD-1:PD-L1 interaction, while mAb B blocks the PD-1:PD-L1 interaction.

For ease, PD-1 binding domains which compete with nivolumab and/or pembrolizumab are hereon referred to as anti-PD-1[C], and PD-1 binding domains which do not compete with nivolumab and/or pembrolizumab are referred to as anti-PD-1[NC].

C. Example 3: PD-1-Targeted IL-15/Rα-Fc Fusions

Here, we describe the generation and characterization of IL-15/Rα-Fc fusions targeted to PD-1, collectively referred to herein as PD-1-targeted IL-15/Rα-Fc fusions.

1. Generation and Physical Characterization of PD-1-Targeted IL-15/Rα-Fc Fusions Plasmids coding for IL-15, IL-15Rα sushi domain, or the anti-PD-1 variable regions were constructed by standard gene synthesis, followed by subcloning into a pTT5 expression vector containing Fc fusion partners (e.g., constant regions as depicted in FIG. 11). Cartoon schematics of illustrative PD-1-targeted IL-15/Rα-Fc fusions are depicted in FIG. 28.

A particular illustrative format, the "scIL-15/RαxFab" format (FIG. 28C), comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH.

We generated PD-1-targeted IL-15/Rα-Fc fusions in this format with both anti-PD-1[C] targeting arms and anti-PD-1[NC] targeting arms. Fusions comprising anti-PD-1[C] targeting arms are referred to herein as [C]PD-1-targeted IL-15/Rα-Fc fusions, while fusions comprising anti-PD-1[NC] targeting arms are referred to herein [NC]PD-1-targeted IL-15/Rα-Fc fusions.

As described in Example 1B(a), scIL-15/Rα-Fc fusions comprising the IL-15(D30N/D64N/N65D) potency variant was almost completely inactive in proliferating various lymphocyte populations. Accordingly, we generated prototype PD-1-targeted IL-15/Rα-Fc fusions (both [C] and [NC]) with the IL-15(N4D/N65D) variant. Prototype [C]PD-1-targeted IL-15/Rα-Fc fusions were generated using the variable regions of humanized 1C11, and prototype [NC]PD-1-targeted IL-15/Rα-Fc fusions were generated using the variable regions of humanized mAb A and mAb B. Sequences for an illustrative [C]PD-1-targeted IL-15/Rα-Fc fusion protein as such are depicted in FIG. 29; and sequences for illustrative [NC]PD-1-targeted IL-15/Rα-Fc fusion proteins as such are depicted in FIG. 30. Illustrative [C]PD-1-targeted IL-15/Rα-Fc fusion protein XENP25850 and [NC]PD-1-targeted IL-15/Rα-Fc fusions were also generated with Xtend Fc (M428L/N434S). We also generated a control RSV-targeted IL-15/Rα-Fc fusion protein XENP26007, sequences for which are depicted in FIG. 31.

Proteins were produced by transient transfection in HEK293E cells and were purified by a two-step purification process comprising protein A chromatography and ion exchange chromatography.

2. 3B: PD-1-Targeted IL-15/Rα-Fc Fusions are Active In Vitro

In a first experiment investigating the activity of PD-1-targeted IL-15/Rα-Fc fusion, human PBMCs were stimulated for 48 hours with 100 ng/ml plate-bound anti-CD3 (OKT3), then CFSE labeled and incubated with the indicated test articles for 4 days at 37° C. Proliferation of CD8$^+$ and CD4$^+$ T cells was measured by CFSE dilution and Zombie dye was used to exclude dead cells. Data depicting percentage of proliferating CD8$^+$ T cells and CD4$^+$ T cells are depicted in FIG. 32.

The data show that each of the PD-1-targeted IL-15/Rα-Fc fusions (both [C] and [NC] versions) are active in proliferating both CD8$^+$ and CD4$^+$ T cells. Additionally, control RSV-targeted IL-15/Rα-Fc fusion was also active in proliferating T cells, while anti-PD-1 mAb XENP28519 alone was not.

3. PD-1 Targeted IL-15/Rα-Fc Fusions are Selective for Activated Lymphocytes

Following binding of cytokines to their receptors, Janus kinases (JAKs) associated with the receptors phosphorylate STAT proteins which then translocate into the nucleus to regulate further downstream processes. Therefore, phosphorylation of STAT proteins (in particular, STAT5, which include STAT5a and STAT5b) is one of the earliest signaling events triggered by IL-15 binding to its receptors. Accordingly, the ability of the PD-1-targeted IL-15/Rα-Fc fusions to induce STAT5 phosphorylation in various cell types was investigated.

For this experiment, both fresh and activated PBMCs were used. Activated PBMCs, used as surrogates for activated lymphocytes in the tumor environment having upregulated PD-1 expression, were prepared by stimulating fresh PBMCs with 100 ng/mL plate-bound anti-CD3 (OKT3) for 2 days. Fresh and activated PBMCs were incubated with XENP25850 at the indicated concentrations for 15 minutes at 37° C. To gate for various cell populations following incubation, PBMCs were stained with anti-CD3-BUV395 (UCHT1), anti-CD4-BV605 (RPA-T4), and anti-CD8-Alexa700 (SK1) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA-BV510 (HI100), and anti-pSTAT5-Alexa647 (pY687) to mark various cell populations and STAT5 phosphorylation. Data depicting induction of STAT5 phosphorylation on various CD8$^+$ and CD4$^+$ T cell populations are depicted in FIG. 33. Notably, the data show that the PD-1-targeted IL-15/Rα-Fc fusion protein XENP25850 demonstrated increased effect on T cells from activated PBMCs while maintaining minimal effect on T cells from fresh PBMCs. This suggests that, in a clinical setting, the PD-1-targeted IL-15/Rα-Fc fusions will be selective for activated tumor-infiltrating lymphocytes in the tumor environment.

D. Example 4: [NC]PD-1-Targeted IL-15/Rα-Fc Fusions Combine with PD-1 Blockade

1. PD-1 Blockade does not Interfere with Activity of [NC]PD-1-Targeted IL-15/Rα-Fc Fusions In Vitro Fresh PBMCs were stimulated with 100 ng/mL plate-bound anti-CD3 (OKT3) for 2 days. Activated PBMCs were pre-incubated for 30 minutes with 100 µg/mL XENP16432, pembrolizumab, or XENP15074 (anti-RSV mAb as control). Following pre-incubation, PBMCs were incubated with the indicated test articles at the indicated concentrations for 15 minutes at 37° C. To gate for various cell populations following incubation, PBMCs were first stained with anti-CD3-BUV395 (UCHT1), anti-CD4-BV605 (RPA-T4), anti-CD25-BV421 (M-A251), and anti-CD45RA-BV510 (HI100) antibodies. Following the first stain, cells were permeabilized using PerFix EXPOSE (Beckman Coulter, Indianapolis, Ind.). Following permeabilization, cells were stained with anti-CD8-PerCP/Cγ5.5 (RPA-T8), antipSTAT5-AF647, and anti-PD-1-APC-Fire750 (EH12.2H7). Following the second staining, the cells were analyzed by flow cytometry to investigate STAT5 phosphorylation on CD8+CD45RA-CD25+PD-1+(as depicted in FIG. 34) and CD4+CD45RA-CD25+PD-1+ T cells (data not shown).

The data show that pre-incubation of PBMCs with XENP16432 or pembrolizumab reduced the activation of T cells by [C]PD-1-targeted IL-15/Rα-Fc fusion XENP25937 in comparison to when PBMCs were pre-incubated with anti-RSV mAb XENP15074, indicating, as expected, that the anti-PD-1 mAbs prevented binding of the [C]PD-1-targeted IL-15/Rα-Fc fusion XENP25937 to T cells. On the other hand, pre-incubation of PBMCs with XENP16432 or pembrolizumab did not affect the activation of T cells by [NC]PD-1-targeted IL-15/Rα-Fc fusion XENP28523 in comparison to when PBMCs were pre-incubated with anti-RSV mAb XENP15074. This suggests that the [NC]PD-1-targeted IL-15/Rα-Fc fusions could be stacked with anti-PD-1 mAbs without negative effect.

2. [NC]PD-1-Targeted IL-15/Rα-Fc Fusions Combine Synergistically with PD-1 Blockade In Vivo The PD-1-targeted IL-15/Rα-Fc fusions were evaluated in a Graft-versus-Host Disease (GVHD) model conducted in NSG (NOD-SCID-gamma) immunodeficient mice. When the NSG mice are engrafted with human PBMCs, the human PBMCs develop an autoimmune response against mouse cells and subsequently GVHD. As such, GVHD is a model for anti-tumor response. Treatment of huPBMC-engrafted NSG mice with PD-1-targeted IL-15/Rα-Fc fusions should enhance proliferation of the engrafted T cells and enhance GVHD.

In a first GVHD study, NSG mice were engrafted with $10 \times 10^6$ human PBMCs via IV-OSP on Day −1 and dosed intraperitoneally with the indicated test articles at the indicated concentrations on Days 0, 7, 14, and 21. Body weights were assessed twice per week as an indicator of GVHD (change in body weight as a percentage of initial body weight depicted in FIG. 35), and blood was drawn on Days 7, 10, and 14 to assess expansion of various lymphocytes (data for Day 14 are depicted respectively in FIG. 36). The expression of CD25 on CD8+ and CD4+ T cells was also assessed as a T cell activation marker (as depicted in FIG. 37).

The data show each of the PD-1-targeted IL-15/Rα-Fc fusions (both [C] and [NC]) enhanced GVHD in comparison to PD-1 blockade alone (either XENP16432 or XENP28437) as well as by scIL-15/Rα-Fc XENP24050 alone as indicated by CD45+ cell, CD3+ T cell, CD8+, T cell, and CD4+ T cell counts. However, consistent with the in vitro data above, combining the [C]PD-1-targeted IL-15/Rα-Fc fusion XENP25850 with XENP28437 led to a reduction in the various cell counts, while combining [NC]PD-1-targeted IL-15/Rα-Fc fusions XENP28532 (based on mAb A) and XENP28692 (based on mAb B) resulted in further enhanced GVHD as indicated by cell counts. A similar trend is also observed using change in body weight as an indicator of GVHD as depicted in FIG. 35, as well as for activation of CD8+ and CD4+ T cells as depicted in FIG. 37. Additionally, as depicted in FIG. 38, there appears to be a preference for CD4+ T cells by the PD-1-targeted IL-15/Rα-Fc fusions as indicated by a lower CD8+ to CD4+ T cell ratio.

In a second GVHD study, NSG mice were engrafted with 10×106 human PBMCs via IV-OSP on Day −1 and dosed intraperitoneally with the indicated test articles at the indicated concentrations on Days 0, 7, 14, and 21. Body weights were assessed twice per week as an indicator of GVHD, and blood was drawn on Days 7, 10, and 14 to assess expansion of various lymphocytes (as depicted in FIG. 39 for Day 10). The expression of CD25 on CD8+T and CD4+ cells was also assessed as depicted in FIG. 40.

As above, the data show that the [NC]PD-1-targeted IL-15/Rα-Fc fusion expanded T cell counts in comparison to anti-PD-1 blockade alone. In addition, the data show a clear dose response for T cell expansion as indicated by enhanced GVHD with higher concentrations (0.3 mg/kg vs 0.1 mg/kg) of the [NC]PD-1-targeted IL-15/Rα-Fc fusion XENP28532. Notably, the combination of XENP28532 (at 0.3 mg/kg) and PD-1 blockade mAb XENP28437 enhanced expression of CD25 on CD8+ and CD4+ T cells.

E. Example 5: Generation of [NC]PD-1-Targeted IL-15/Rα-Fc Fusions Having Alternative IL-15 Potency Variants 1. PD-1-Targeted IL-15/Rα-Fc Fusions Comprising IL-15 (N4D/N65D) Variant Demonstrate Less than Favorable Pharmacokinetics In a study investigating the pharmacokinetics of IL-15/Rα-Fc potency variants with Xtend, cynomolgus monkeys were administered a first single intravenous (i.v.) dose of XENP22853 (WT IL-15/Rα-heteroFc with Xtend), XENP24306 (IL-15(D30N/E64Q/N65D)/Rα-heteroFc with Xtend), XENP24113 (IL-15(N4D/N65D)/Rα-heteroFc with Xtend), XENP24294 (scIL-15(N4D/N65D)/Rα-Fc with Xtend), and XENP25937 ([C]PD-1-targeted IL-15(N4D/N65D)/Rα-Fc with Xtend) at varying concentrations.

FIG. 41 depicts the serum concentration of the test articles over time following the first dose. As expected, incorporating potency variants in addition to Xtend substitution (as in XENP24306 and XENP24113) greatly improves the pharmacokinetics of IL-15/Rα-Fc fusions (in comparison to XENP22583). Unexpectedly, PD-1-targeted IL-15/Rα-Fc fusion XENP25937 comprising the IL-15(N4D/N65D) variant demonstrated substantially inferior pharmacokinetics in comparison to XENP24306. Similarly, IL-15/Rα-heteroFc fusion XENP24113 and scIL-15/Rα-Fc fusion XENP24294 (which have the same IL-15(N4D/N65D) potency variant) also demonstrated substantially inferior pharmacokinetics in comparison to XENP24306. This suggests that the inferior pharmacokinetics may be due to the particular IL-15 potency variant rather than the format of the PD-1-targeted IL-15/Rα-Fc fusion. While a decrease in pharmacokinetics for XENP25937 (as well as XENP24113) was expected on the basis of the IL-15/Rα-Fc fusions having IL-15(N4D/N65D) variant demonstrating greater in vitro potency than IL-15/Rα-Fc fusions having the IL-15(D30N/E64Q/N65D) variant (as described in Example 1B(a)), the decrease in pharmacokinetics was unexpectedly disproportionate to the increase in potency. Accordingly, we sought to identify alternative IL-15 potency variants for use in the PD-1-targeted IL-15/Rα-Fc fusions of the invention.

2. Engineering PD-1-Targeted IL-15/Rα-Fc Fusions Comprising IL-15 Variants with Modifications at the IL-15:CD132 Interface We noted that the IL-15(N4D/N65D) variant has both its substitutions at the IL-15 interface responsible for binding to CD122, while IL-15(D30N/E64Q/N65D) has two substitutions (E64Q and N65D) at IL-15:CD122 interface; and one substitution (D30N) at the IL-15 interface responsible for binding to CD132. Accordingly, we reasoned that the modification at the IL-15:CD132 interface may contribute to the superior pharmacokinetics observed for XENP24306. Therefore, we generated additional illustrative PD-1-targeted IL-15/Rα-Fc fusions comprising the IL-15(D30N/N65D) variants, sequences for which are depicted in FIG. 42.

F. Example 6: PD-1-Targeted IL-15/Rα-Fc Fusions Induces Internalization of PD-1 on T Cells In another experiment investigating the activity of PD-1-targeted IL-15/Rα-Fc fusion, CFSE-labeled human PBMCs were incubated for 4 days at 37° C. with 20 ng/ml plate-bound anti-CD3 (OKT3) and the following test articles: XENP28532 (PD-1-targeted IL-15/Rα-Fc fusion comprising an αPD-1 arm based on mAb A), XENP24306 (control untargeted IL-15/Rα-Fc fusion), and XENP26007 (control RSV-targeted IL-15/Rα-Fc fusion). Cells were then labeled with αPD-1 XENP16432, which as shown in Example 2C and FIG. 34 does not compete for binding with the PD-1-targeting arm of XENP28532, and analyzed by flow cytometry. Data depicting the percentage of various T cell populations which are PD-1+ are depicted in FIG. 44. We surprisingly observed a dose dependent reduction of PD-1 on T cells following treatment with the PD-1-targeted IL-15/Rα-Fc fusion, in comparison to treatment with the controls XENP24306 and XENP26007, indicating that the PD-1 receptors were internalized. This suggests a potential long-lasting action for the PD-1-targeted IL-15/Rα-a. Fc, wherein subsequent to the eventual clearance of PD-1-targeted IL-15/Rα-Fc molecules, immune inhibition by PD-1 ligands (e.g. PD-L1 and PD-L2) could remain diminished.

G. Example 7: Identification of a Cynomolgus Cross-Reactive [NC]PD-1 mAb C

For ease of clinical development, it is useful to investigate various parameters of the [NC]PD-1-targeted IL-15/Rα-Fc fusions such as pharmacokinetics, pharmacodynamics, and toxicity in cynomolgus monkeys. Accordingly, we sought to identify [NC]PD-1 targeting arms cross-reactive for human and cynomolgus PD-1. We identified an additional anti-PD-1 binding domain (referred to herein as mAb C) which we humanized using string content optimization (see, e.g., U.S. Pat. No. 7,657,380, issued Feb. 2, 2010), sequences for which are depicted in FIGS. 43 (variable domain sequences) and 45 (bivalent mAbs as XENP28536, XENP28537, XENP28538, and XENP28539).

1. Anti-PD-1 mAb C is Cross-Reactive for Human and Cynomolgus PD-1

We investigated the binding of XENP28536, XENP28537, XENP28538, and XENP28539 to human and cynomolgus PD-1 using Octet, as generally described above. In particular, anti-human Fc (AHC) biosensors were used to capture the antibodies and dipped into multiple concentrations of human and cynomolgus PD-1-His to determine KD, data for which are depicted in FIG. 46. The data show that humanized variants XENP25836 and XENP25837 both bound to human and cynomolgus with similar KD. Notably, humanized variants XENP25838 and XENP25839 lost their ability to bind both human and cynomolgus PD-1. In comparison, XENP28519 (humanized mAb A) binds more tightly to human PD-1, but is not cross-reactive for cynomolgus PD-1.

2. Anti-PD-1 mAb C does not Compete for Binding with Nivolumab and Pembrolizumab To investigate if mAb C competed with nivolumab and pembrolizumab, we performed tandem epitope binning on the chimeric mAb C as described in Example 2C. Data are depicted in FIG. 47 for XENP16432, XENP21461, and chimeric mAb C. The binning show that anti-PD-1 mAb C does not compete with nivolumab or pembrolizumab, and is a partial blocker of the PD-1:PD-L1 interaction.

H. Example 8: [NC]PD-1-Targeted IL-15/Rα-Fc Fusions Based on mAb C

[NC]PD-1-targeted IL-15/Rα-Fc fusions in the "scIL-15/RαxFab" format based on mAb C and IL-15 variants were engineered and produced as generally described in Example 3, illustrative sequences for which are depicted in FIG. 48. It should be noted that fusions were produced with IL-15 (N4D/N65D) variants, as well as IL-15(D30N/N65D) variants in line with the notion described in Example 5 that IL-15 variants comprising modifications at the IL-15:CD132 interface may have enhanced pharmacokinetics. Additionally, sequences for Xtend Fc (M428L/N434S) analogs are depicted in FIG. 49.

1. 8A: [NC]PD-1-Targeted IL-15/Rα-Fc Fusions Based on mAb C are Active In Vitro a. 8A(a): Induction of T Cell Proliferation Human PBMCs were stimulated with 500 ng/ml plate-bound anti-CD3 (OKT3) for 48 hours, labeled with CFSE, and incubated for 4 days at 37° C. with the following test articles: XENP28543 ([NC]PD-1-targeted IL-15/Rα-Fc based on mAb C_H1_L1 and IL-15(N4D/N65D)), XENP28532 ([NC]PD-1-targeted IL-15/Rα-Fc based on mAb A_H1_L1 and IL-15(N4D/N65D)), XENP24306 (untargeted IL-15/Rα-heteroFc based on IL-15(D30N/E64Q/N65D)), and XENP26007 (control RSV-targeted IL-15/Rα-Fc based on motavizumab and IL-15(N4D/N65D)). Following incubation, Cells were stained with the following antibodies: anti-LAG-3-PE (3DS223H), anti-CD8-PerCP-Cγ5.5 (SK1), anti-CD3-PE-Cy7 (OKT3), anti-PD-1-Alexa647 (XENP16432, stained with Alexa Fluor™ 647 Antibody Labeling Kit), anti-CD45RO-APC-Fire750 (UCHL1), anti-HLA-DR-Alexa700 (L243), anti-TIGIT-BV421 (A15153G), anti-CD16-BV605 (3G6), anti-CD56-BV605 (HCD56), anti-CD25-BV711 (M-A251), anti-CD45RA-BV785 (HI100), anti-CD4-BUV395 (SK3), and Zombie Aqua-BV510 and analyzed by flow for various cell populations.

We investigated the proliferation of various T cell populations based on CFSE dilution (Zombie Aqua to exclude dead cells), data for which are depicted in FIG. 50. Both [NC]PD-1-targeted IL-15/Rα-Fc fusions induced proliferation of CD8+ and CD4+ T cells. Notably, the [NC]PD-1-targeted IL-15/Rα-Fc fusions were more potent in inducing proliferation of CD4+ T cells in comparison to untargeted IL-15(D30N/E64Q/N65D)/Rα-Fc fusion (as well as control RSV-targeted IL-15/Rα-Fc fusion), but less potent in inducing proliferation of CD8+ T cells. Further, XENP28532 (PD-1-targeting arm based on mAb A) appeared more potent than XENP28543 (PD-1-targeting arm based on mAb C) in inducing proliferation of both CD8+ and CD4+ T cells.

Interestingly, as shown in FIG. 51, XENP28532 was more potent in inducing proliferation of CD8+LAG-3+ T cells in comparison to untargeted IL-15(D30N/E64Q/N65D)/Rα-Fc fusion (as well as control RSV-targeted IL-15/Rα-Fc fusion). Additionally, XENP28543 was more potent in inducing CD8+LAG-3+ T cell proliferation than bulk CD8+ T cell proliferation (EC50 276.8 vs. 71.94). Collectively, this supports the notion that the [NC]PD-1-targeted IL-15/Rα-Fc fusions may be selective for T cells expressing checkpoints such as those that would be found in the tumor environment.

We also investigated proliferation of memory (CD45RA−) and naive (CD45RA+) populations, as depicted in FIG. 52. Notably, while the [NC]PD-1-targeted IL-15/Rα-Fc fusions were more potent than the untargeted IL-15 (D30N/E64Q/N65D)/Rα-Fc fusion in inducing proliferation of CD4+CD45RA− T cells, they were less potent in inducing proliferation of CD4+CD45RA+ T cells, suggesting a selectivity for memory T cells.

Finally, we investigated the expression of PD-1 on various T cell populations (stained using XENP16432, which as shown herein, bins to a different epitope than mAb A and mAb C). The data, as depicted in FIG. 53, show a dose dependent reduction of PD-1 on CD4+CD45RA− T cells following treatment with both [NC]PD-1-targeted IL-15/Rα-Fc fusions, in comparison to treatment with the controls XENP24306 and XENP26007, indicating that the PD-1 receptors were internalized. Notably, downregulation of PD-1 was more potently induced by XENP28532, with a PD-1-targeting arm based on mAb A.

b. 8A(b): Induction of Cytokine Secretion

Human PBMCs were prestimulated with various concentrations of plate-bound anti-CD3 (OKT3) for 48 hours at 37° C., labeled with CFSE, and incubated with indicated test articles for 4 days at 37° C. Supernatant was collected and assessed by V-PLEX Proinflammatory Panel 1 Human Kit (according to manufacturer protocol; Meso Scale Discovery, Rockville, Md.). Data depicted in FIG. 54 show that both XENP28532 and XENP28543 were able to potently stimulate IFNγ secretion. Notably, XENP28532 (PD-1-targeting arm based on mAb A) appeared more active than XENP28543 (PD-1-targeting arm based on mAb C) in inducing IFNγ secretion.

c. 8A(c): PD-1 Blockade does not Interfere with Activity of [NC]PD-1-Targeted IL-15/Rα-Fc Fusion Based on mAb C In Vitro We investigated the potential interference of PD-1 blockade with the activity of [NC]PD-1-targeted IL-15/Rα-Fc fusion based on mAb C as described in Example 4A. Data as depicted in FIG. 55 show that pre-incubation of PBMCs with XENP16432 or pembrolizumab did not affect the activation of T cells by [NC]PD-1-targeted IL-15/Rα-Fc fusion XENP28543 in comparison to when PBMCs were pre-incubated with anti-RSV mAb XENP15074. This suggests that [NC]PD-1-targeted IL-15/Rα-Fc fusions with PD-1-targeting arm based on mAb C could be stacked with anti-PD-1 mAbs without negative effect.

2. 8B: [NC]PD-1-Targeted IL-15/Rα-Fc Fusions Based on mAb C Enhance GVHD In Vivo and Combine with PD-1 Blockade In the second GVHD study described in Example 4B, we also investigated the in vivo activity of XENP28543 at various concentrations, alone and in combination with PD-1 blockade. Data depicting change in body weight (as a percentage of initial body weight) over time are depicted in FIG. 56, and data depicting body weight (as a percentage of initial body weight) on Days 11, 14, and 18 are depicted in FIG. 57. We also investigated the expansion and activation of various lymphocyte populations, data for which are depicted in FIGS. 58-59 for Day 14. Collectively, the data show that the combination of [NC]PD-1-targeted IL-15/Rα-Fc fusion with PD-1 blockade significantly enhanced GVHD over treatment with [NC]PD-1-targeted IL-15/Rα-Fc fusion alone. The enhancement in effect is especially pronounced in the context of combinations of lower concentrations (i.e. 0.1 mg/kg) of [NC]PD-1-targeted IL-15/Rα-Fc fusions with PD-1 blockade.

3. 8C: [NC]PD-1-Targeted IL-15/Rα-Fc Fusions Based on mAb C Combine with PD-1 Blockade to Enhance Anti-Tumor Activity in NSG Mice NSG mice (10 per group) were intradermally inoculated with 3×106 pp65-transduced MCF-7 cells on Day −15. Mice were then intraperitoneally injected with 5×106 human PBMCs (or PBS for control) and treated with the indicated test articles on Day 0, and further treated with the indicated test articles on Days 7, 14, 21, 29, and 36. Tumor volume was measured by caliper three times per week, body weights were measured once per week, and blood was drawn once per week.

Tumor volume over time are depicted in FIG. 60, and tumor volume on Days 26, 28, 30, 33, 35, and 37 are depicted in FIG. 61. The data show that by Day 28, the combination of XENP28543 with PD-1 blockade effected significantly reduced tumor size over treatment with PD-1 blockade alone. We also investigated the expansion and activation of various lymphocyte populations, data for which are depicted in FIGS. 62-63. Notably, the [NC]PD-1-targeted IL-15/Rα-Fc fusions, alone or in combination with PD-1 blockade, enabled significantly enhanced early (Day 7 post-dose) induction of CD8+ T cell activation in comparison to PD-1 blockade alone; and both the [NC]PD-1-targeted IL-15/Rα-Fc fusions in combination with PD-1 blockade enabled significantly enhanced early (Day 7 post-dose) induction of CD4+ T cell activation in comparison to PD-1 blockade alone. Additionally by Day 14, the [NC]PD-1-targeted IL-15/Rα-Fc fusions, alone or in combination with PD-1 blockade, enabled significantly enhanced expansion of numerous lymphocyte populations in comparison to PD-1 blockade alone.

I. Example 9: [NC]PD-1-Targeted IL-15/Rα-Fc Fusions Having Affinity-Optimized PD-1-Targeting Arm 1. 9A: Affinity Optimization of mAb C-Based ABD As described in Example 8A, in certain contexts such as in vitro downregulation of PD-1, proliferation of T cells, and induction of cytokine secretion, XENP28532 (PD-1-targeting arm based on mAb A) appeared more potent and/or active than XENP28543 (PD-1-targeting arm based on mAb C). As noted in Example 7A, bivalent mAb based on humanized mAb A (XENP28519) bound more tightly than bivalent mAb based on humanized mAb C (XENP28536) to human PD-1. In view of this, we reasoned that the affinity of the PD-1-targeting arm for PD-1 may impact on the activity of the PD-1-targeted IL-15/Rα-Fc fusion. Accordingly, we engineered affinity optimized variants of mAb C. A library of variants was constructed by standard mutagenesis to introduce point mutations into the variable heavy or variable light regions of XENP28536. Illustrative sequences for which are depicted in FIGS. 43 (variable domain sequences) and 64 (bivalent mAbs). Affinity screens of the affinity-engineered mAb C[PD-1]_H1_L1 variants (in bivalent IgG1 format with E233P/L234V/L235A/G236/S267K ablation variants) were performed on Octet as generally described above, data for which are depicted in FIG. 65. Out of 304 variants having single point mutation in either the variable heavy or variable light region, we only identified 11 variants (including mAb C[PD-1]_H1_L1.1 and mab_C[PD-1]_H1_L1.3) having greater than 2-fold improved affinity over WT. Favorable VH substitutions were at positions 32, 52A, and 97 (numbering according to Kabat); and favorable VL substitutions were at positions 27D, 30, 93, and 94 (numbering according to Kabat).

To further enhance affinity, favorable single substitution VH variants and single substitution VL variants were combined. These new VH/VL combo variants were constructed in the context of PD-1-targeted IL15/Rα-Fc fusions. Data depicting the affinity of the fusions for PD-1 are shown in FIG. 66. Notably, H1.19_L1.1 has higher affinity than H1.132_L1.1, despite H1.132_L1 provided higher affinity than H1.19_L1, suggesting synergistic affinity enhancement provided by F32L substitution in VH (numbering according to Kabat) as in H1.19.

Next, favorable single substitutions in the VH and/or the VL were combined with new variants constructed in the context of PD-1-targeted IL15/Rα-Fc fusions. Data depicting the affinity of the fusions for PD-1 are depicted in FIG. 67. Triple substitution VL variant L1.140 (comprising histidine at position 27D, tyrosine at position 30, and threonine at position 93; numbering according to Kabat) demonstrated 36-fold improvement in KD over wild-type, and combines well with VH variants (e.g. H1.132 and H1.175) to exert ~100-fold improvement in KD over wild-type.

Notably, a ladder of affinity variants were generated by combining single substitutions in the VH or VL, as well as by combining VH variants and VL variants which find use in tuning the potency and selectivity of PD-1-targeted IL-15/Rα-Fc fusions.

[NC]PD-1-targeted IL-15/Rα-Fc fusions in the "scIL-15/RαxFab" format based on affinity-enhanced mAb C and IL-15 variants were engineered and produced as generally described in Example 3, illustrative sequences for which are depicted in FIG. 68 as XENP30046, XENP30047, XENP30049, and XENP30050. Additionally, sequences for Xtend Fc (M428L/N434S) analogs are depicted in FIG. 69.

2. 9B: [NC]PD-1-Targeted IL-15/Rα-Fc Fusions with Improved PD-1 Binding have Enhanced Activity In Vitro Next, we investigated the impact of affinity-enhanced PD-1-targeting arm (as well as the IL-15(D30N/N65D) variant) on the PD-1-targeted IL-15/Rα-Fc fusions of the invention. Human PBMCs were stimulated for 48 hours with 500 ng/ml plate-bound anti-CD3 (OKT3) and then labeled with CFSE and incubated with the test articles for 4 days at 37° C. Cells were stained with the following antibodies: anti-CD8-PerCP-By5.5 (SK1), anti-CD3-PE-Cy7 (OKT3), anti-PD-1-Alexa647 (XENP16432, stained with Alexa Fluor™ 647 Antibody Labeling Kit), anti-CD45RO-APC-Fire750 (UCHL1), anti-HLA-DR-Alexa700 (L243), anti-CD107a-BV421 (H4A3), anti-CD16-BV605 (3G6), anti-CD56-BV605 (HCD56), anti-CD25-BV711 (M-A251), anti-CD45RA-BV785 (M-A251), anti-CD4-BUV395 (SK3), and Zombie Aqua (BV510), and analyzed by flow cytometry for various cell populations.

We investigated the proliferation of various T cell populations based on CFSE dilution (Zombie Aqua to exclude dead cells), data for which are depicted in FIG. 70; the activation of various T cell populations based on expression of CD25 (a late stage T cell activation marker), data for which are depicted in FIGS. 71-72; and expression of PD-1 on various populations, data for which are depicted in FIG. 73 for CD4+CD45RA-PD-1+ T cells.

Collectively, the data show that activity of the PD-1-targeted IL-15/Rα-Fc fusions correlate with PD-1 affinity. For example, as shown in FIG. 70, XENP30046 (having an affinity-enhanced PD-1-targeting arm) induces proliferation of both CD8+ and CD4+ T cells more potently than does XENP28543 (2-fold increase). Notably, even downregulation of PD-1 on T cells by the PD-1-targeted IL-15/Rα-Fc fusions correlates with PD-1 affinity, as shown in FIG. 73. Additionally, the data show that the IL-15(D30N/N65D) variant does not drastically affect the activity of the PD-1-targeted IL-15/Rα-Fc fusions.

3. 9C: [NC]PD-1-Targeted IL-15/Rα-Fc Fusions with Improved PD-1 Binding have Enhanced Activity In Vivo NSG mice were engrafted with 10×10⁶ human PBMCs via IV-OSP on Day −1 and dosed intraperitoneally on Days 0, 7, and 14 with the following test articles: XENP28437 (anti-PD-1 mAb based on pembrolizumab with E233P/L234V/L235A/G236del/S67K ablation variants), and XENP29481 (control RSV-targeted IL-15/Rα-Fc fusion having D30N/N65D IL-15 variant; sequences for which are depicted in FIG. 31). Body weights were assessed twice per week as an indicator of GVHD, data for which are depicted in FIGS. 74-75 as a change in initial body weight. Notably, treatment with XENP30046 alone (having affinity-enhanced PD-1-targeting arm) resulted in significant body weight loss as measured on Days 11 and 18 in comparison to PBS treatment, whereas, treatment with XENP28543 alone did not yield significant weight loss (in comparison to PBS treatment).

Blood was drawn on Days 7, 10, and 14 to investigate expansion of human lymphocytes as well as to investigate cytokine secretion, data for which are depicted in FIG. 76. Collectively, the data generally show enhanced activity by the [NC]PD-1-targeted IL-15/Rα-Fc fusions having affinity-enhanced PD-1 targeting arm. Additionally, the data show that the [NC]PD-1-targeted IL-15/Rα-Fc combine productively with PD-1 blockade (XENP28437).

Furthermore, as shown in FIGS. 78 and 79, XENP30046 significantly enhanced expansion of CD45+ cells, CD3+ T cells, CD4+ T cells, CD8+ T cells, and NK cells by Day 11 in comparison to dosing with XENP28543 which is sustained for all populations (except NK cells) up to Day 14. Additionally as shown in FIG. 77, XENP30046 significantly enhanced early (Day 7 post-dose) activation of CD8+ and CD4+ T cells (as indicated by CD25 expression) in comparison to XENP28543.

J. Example 10: Fine Tuning Potency and Selectivity of PD-1-Targeted IL-15/Rα-Fc Fusions by Tuning PD-1 Affinity and IL-15 Potency Although the PD-1-targeted IL-15/Rα-Fc fusions were designed with the aim to be targeted to the tumor environment via the PD-1-targeting arm, the cytokine moiety is still capable of signaling before reaching the tumor site and may contribute to systemic toxicity. Accordingly, we sought to further reduce the IL-15 potency by constructing PD-1-targeted IL-15/Rα-Fc fusions with IL-15(D30N/E64Q/N65D) variant, which as described in Example 1B(a) has drastically reduced activity. Sequences for illustrative PD-1-targeted IL-15/Rα-Fc fusions comprising IL-15(D30N/E64Q/N65D) variant are depicted in FIGS. 30 and 48-49 as XENP30428, XENP30429, XENP30430, XENP30519, XENP30516, XENP30517, and XENP30455. Additionally, we constructed XENP30432, a RSV-targeted IL-15/Rα-Fc fusion comprising IL-15(D30N/E64Q/N65D) variant (sequences for which are depicted in FIG. 32), to act as a surrogate for investigating the behavior of PD-1-targeted IL-15/Rα-Fc fusions comprising IL-15(D30N/E64Q/N65D) variant outside of the tumor environment.

1. 10A: In Vitro Activity of [NC]PD-1-Targeted IL-15/Rα-Fc Fusions Tuned for PD-1 Affinity and IL-15 Potency The in vitro activity of additional [NC]PD-1-targeted IL-15/Rα-Fc fusions having various PD-1-binding affinity and IL-15 potencies. Human PBMCs were stimulated for 48 hours with 500 ng/ml plate-bound anti-CD3 (OKT3) and then labeled with CFSE and incubated with the test articles for 4 days at 37° C. Cells were stained with the following antibodies: anti-CD8-PerCP-Cγ5.5 (SK1), anti-CD3-PE-Cy7 (OKT3), anti-PD-1-Alexa647 (XENP16432, stained with Alexa Fluor™ 647 Antibody Labeling Kit), anti-CD45RO-APC-Fire750 (UCHL1), anti-HLA-DR-Alexa700 (L243), anti-CD107a-BV421 (H4A3), anti-CD16-BV605 (3G6), anti-CD56-BV605 (HCD56), anti-CD25-BV711 (M-A251), anti-CD45RA-BV785 (M-A251), anti-CD4-BUV395 (SK3), and Zombie Aqua (BV510), and analyzed by flow cytometry for various cell populations.

We investigated the proliferation of various T cell populations based on CFSE dilution (Zombie Aqua to exclude dead cells), data for which are depicted in FIG. 80; the activation of various T cell populations based on expression of CD25 (a late stage T cell activation marker), data for which are depicted in FIG. 81-82; and expression of PD-1 on various populations, data for which are depicted in FIGS. 83-84.

The data show that XENP30272 (which has higher affinity PD-1 binding) is more potent at inducing proliferation and activation of various T cell populations than XENP30046 (which has lower affinity PD-1 binding) demonstrating the importance of tuning PD-1 affinity. Notably, while XENP30429 (PD-1-targeted IL-15/Rα-Fc fusions having IL-15(D30N/E64Q/N65D) variant) was only 1.8 to 2.5 less active on CD8+ and CD4+ T cells in comparison to XENP30046 (PD-1-targeted IL-15/Rα-Fc fusions having IL-15(N4D/N65D) variant), XENP30432 (surrogate RSV-targeted IL-15/Rα-Fc having IL-15(D30N/E64Q/N65D) variant) was 12 fold less active on CD8+ T cells and 530 fold less active on CD4+ T cells in comparison to XENP30046 (based on proliferative activity as depicted in FIG. 80). This suggests that PD-1-targeted IL-15/Rα-Fc fusions having IL-15(D30N/E64Q/N65D) variant should retain activity in the tumor environment, while remaining substantially inactive outside of the tumor environment.

2. 10B: In Vivo Activity of [NC]PD-1-Targeted IL-15/Rα-Fc Fusions Tuned for IL-15 Potency The in vivo expansion of lymphocytes by [NC]PD-1-targeted IL-15/Rα-Fc fusions tuned for IL-15 Potency was investigated in a GVHD study. NSG mice were engrafted with 10×106 human PBMCs via IV-OSP on Day −1 and dosed intraperitoneally with the indicated test articles at the indicated concentrations on Days 0, 7, and 14. Blood was drawn on Days 7, 10, and 14 to assess expansion and activation of various lymphocytes (data for which are shown in FIGS. 85-86). Collectively, the data show that when the PD-1 affinity is equivalent, higher potency IL-15 (e.g. XENP30046) enables greater expansion (and early activation) of T cells in comparison to lower potency IL-15 (e.g. XENP30429).

K. Example 11: [NC]PD-1-Targeted IL-15/Rα-Fc with Xtend

Xtend analogs of the [NC]PD-1-targeted IL-15/Rα-Fc fusions were engineered with the aim to further extend pharmacokinetics and pharmacodynamics, sequences for which are depicted throughout the Figures.

1. 11A: Xtend Analogs Demonstrate Comparable Activity In Vitro

We investigated whether the Xtend analogs were comparable to the non-Xtend molecules. Human PBMCs were stimulated for 48 hours with 500 ng/ml plate-bound anti-CD3 (OKT3) and then labeled with CFSE and incubated with the test articles for 4 days at 37° C. Test articles used were targeted IL-15/Rα-XtendFc fusions with either IL-15 (N4D/N65D), IL-15(D30N/N65D), or IL-15(D30N/E64Q/ N65D) variant and targeting arms based on mAb C_H1_L1 (low affinity), mAb C_H1_L1.1 (high affinity), mAb C_H1_L1.3 (intermediate affinity), or αRSV. Following incubation with the test articles, cells were stained with the following antibodies: anti-CD25-PE (M-A251), anti-CD8-PE-Cy7 (SK1), anti-PD-1-Alexa647 (XENP16432, stained with Alexa Fluor™ 647 Antibody Labeling Kit), anti CD45RO-APC-Fire750 (UCHL1), anti-CD16-BV605 (3G6), anti-CD56-BV605 (HCD56), anti-CCR7-GV711 (G043H7), anti-CD45RA-BV785 (HI100), anti-CD4-BUV395 (SK3), anti-CD3-BUV496 (UCHT1), anti-CD95-BUV737 (DX2), anti-CD28-BV650 (CD28.2), and Zombie Aqua (BV510), and analyzed by flow cytometry for various cell populations.

We investigated the proliferation of various lymphocyte populations based on CFSE dilution (Zombie Aqua to exclude dead cells), data for which are depicted in FIG. 87; the activation of various T cell populations based on CD25 expression, data for which are depicted in FIG. 88; and expression of PD-1 on various populations, data for which are depicted in FIG. 89. Collectively, the data show the same trends as in Example 10. Additionally, the data show that the Xtend analogs are comparable to the non-Xtend analogs. For example, the EC50 for XENP30046 is comparable to the EC50 for XENP30290 (the Xtend analog to XENP30046).

2. 11B: Xtend Analogs Demonstrate Anti-Tumor Activity and Combine with PD-1 Blockade For this study, NSG mice that were MHC I/II-DKO (NSG-DKO) and thus resistant to GVHD were used. NSG-DKO mice (10 per group) were intradermally inoculated with 3×106 pp65-transduced MCF-7 cells on Day −15. Mice were then intraperitoneally injected with 2.5×106 human PBMCs and treated with the indicated test articles/test article combinations on Day 0, and further treated with the indicated test articles on Days 7, 14, and 21. Tumor volume was measured by caliper three times per week, body weights were measured once per week, and blood was drawn once per week.

Tumor volume over time are depicted in FIG. 90, and tumor volume on Days 11, 14, 17, 19, 21, 24, 26, and 28 are depicted in FIG. 91 (statistics performed on baseline corrected data using Mann-Whitney test). The data show that by Day 11, XENP30290 (1 mg/kg) alone and the combination of XENP30516 (3 mg/kg) with PD-1 blockade effected significantly reduced tumor size over treatment with PD-1 blockade alone. By Day 28, all combinations of XENP30290 (0.1, 0.3, or 1 mg/kg) or XENP30516 (0.3, 1, or 3 mg/kg) with PD-1 blockade effected significantly reduced tumor size over treatment with PD-1 blockade alone.

Data depicting the expansion of various lymphocyte populations are depicted in FIGS. 92-93 (statistics for CD45+ cell expansion performed on log-transformed data using unpaired t-test). Notably by Day 14, the various doses of XENP30290 or XENP30516, alone or in combination with PD-1 blockade, enabled significantly enhanced expansion of lymphocytes in comparison to PD-1 blockade alone. Although the control RSV-targeted IL-15/Rα-Fc fusions also expanded lymphocytes, consistent with the data as depicted in Example 10, the RSV-targeted IL-15/Rα-Fc fusions induced far less expansion of lymphocytes than their counterpart (i.e. having equivalent IL-15 variant) PD-1-targeted IL-15/Rα-Fc fusion; and XENP30518 comprising the IL-15(D30N/E64Q/N65D) variant induced less expansion of lymphocytes than XENP30362 comprising the more potent IL-15(N4D/N65D) variant. As above, this indicates that PD-1-targeted IL-15/Rα-Fc fusions will be active in the tumor environment, but will remain substantially inactive outside of the tumor environment.

L. Example 12: PD-1-Targeted IL-15/Rα-Fc Fusions Selectively Expand PD-1⁺ Lymphocyte Populations Example 3C showed that the PD-1-targeted IL-15/Rα-Fc fusions of the invention are selective for activated lymphocytes. Here, it is further demonstrated in vivo that the PD-1-targeted IL-15/Rα-Fc fusions are particularly selective for PD-1+ lymphocyte populations.

CD34+Hu-NSG mice which are NSG mice engrafted with human CD34+ hematopoietic stem cells so as to develop a functional human immune system with no reactivity towards the host were obtained from The Jackson Laboratory (Bar Harbor, Me.). We investigated PD-1 expression levels on various lymphocyte populations in blood drawn from the mice prior to dosing with test articles, data for which are depicted in FIG. 94. The data show that the CD34+Hu-NSG mice do have a PD-1 expression profile similar to humans, that is higher PD-1 expression on effector memory populations. Activity of the PD-1-targeted IL-15/Rα-Fc fusions in the CD45+Hu-NSG mice should reflect the activity of the molecules in human.

Mice were dosed intraperitoneally with 0.3 mg/kg XENP30046 ([NC]PD-1-targeted IL-15/Rα-Fc comprising mAb C_H1_L1.1 and IL-15(N4D/N65D) variant; n=5), 0.3 mg/kg XENP30429 ([NC]PD-1-targeted IL-15/Rα-Fc comprising mAb C_H1_L1.1 and IL-15(D30N/E64Q/N65D) variant; n=5), 0.3 mg/kg XENP26007 (control RSV-targeted IL-15/Rα-Fc comprising IL-15(N4D/N65D) variant; n=4), or 0.3 mg/kg XENP30432 (control RSV-targeted IL-15/Rα-Fc comprising IL-15(D30N/E64Q/N65D) variant; n=5) on Day 0. Blood was drawn on Days 0, 4, 7, and 10 to investigate the expansion of various lymphocyte populations, data for which are depicted in FIGS. 95-102.

The data show that the PD-1-targeted IL-15/Rα-Fc fusions (XENP30046 and XENP30429) expand PD-1+ cell populations (e.g. CD4 and CD8 effector memory populations), with over 100-fold expansion in effector memory populations by XENP30046. FIG. 102 illustrates that the amount of cell expansion by XENP30046 and XENP30429 are correlated with baseline PD-1 expression in each of the lymphocyte populations. Further, as depicted in FIGS. 100 and 101, XENP30429 induced very little expansion of CD4 and CD8 naive cells (PD-1 low) indicating that reducing potency of the IL-15 arm improves selectivity for activated T cells. Notably, the control RSV-targeted IL-15/Rα-Fc fusions (XENP26007 and XENP30432) show very low levels of expansion indicating that the PD-1-targeted IL-15/Rα-Fc fusions of the invention should have minimal peripheral lymphocyte expansion.

M. Example 13: Pharmacokinetics and Pharmacodynamics of [NC]PD-1-Targeted IL-15/Rα-Fc Fusions Tuned for PD-1 Affinity and IL-15 Potency in Cynomolgus Monkeys Based on further analysis of data collected from the cynomolgus study described in Example 5A, it was found that PD-1-targeted IL-15/Rα-Fc fusions decrease NK cell activation while expanding CD8+ T cells in cynomolgus monkeys (see FIG. 103). Notably as depicted in FIG. 104, the PD-1-targeted IL-15/Rα-Fc fusion was selective for CD8 effector memory T cells.

In another in vivo study in cynomolgus monkeys, the pharmacokinetics and pharmacodynamics of [NC]PD-1-targeted IL-15/Rα-Fc fusions tuned for PD-1 affinity and IL-15 potency were investigated. Cynomolgus monkeys (n=3) were acclimated for 13 days (starting on Day −13), followed by intravenous administration of a first lower dose (3× dose) of indicated test articles on Day 1, and an intravenous administration of a higher second dose (10× dose) of indicated test articles on Day 22. Blood was drawn throughout the study to investigate both pharmacokinetics and pharmacodynamics, data for which are depicted in FIGS. 105-106.

FIG. 105 depicts the expansion of various lymphocyte populations in cynomolgus monkeys following administration with either XENP30290 (mAb C_H1_L1.1×IL-15 [N4D/N65D]) or XENP30362 (αRSV×IL-15[N4D/N65D]). Collectively, the data show that XENP30290 (having high PD-1 affinity and higher IL-15 potency) enabled sustained peripheral pharmacodynamics for 2-3 weeks with modest PD1− cell expansion. In particular, γδ T cells are the highest fold expanding cell population; CD4+ and CD8+ naïve T cells are the lowest fold expanding cell population; and CD8+ stem cell memory cells are the highest expanding relevant population.

FIG. 106 depicts the expansion of various lymphocyte populations in cynomolgus monkeys following administration with either XENP30516 (mAb C_H1_L1.1×IL-15 [D30N/E64Q/N65D]) or XENP30518 (αRSV×IL-15 [D30N/E64Q/N65D]). Collectively, the data show that XENP30516 (having high PD-1 affinity and lower IL-15 potency) enabled sustained peripheral pharmacodynamics with no significant PD1-cell expansion. Consistent with XENP30290, γδ T cells are the highest fold expanding cell population; CD4+ and CD8+ naïve T cells are the lowest fold expanding cell population; and CD8+ stem cell memory cells are the highest expanding relevant population.

FIGS. 107-111 depict the pharmacokinetics of the various test articles having different PD-1 affinity (including RSV-targeted control) and/or IL-15 potency. Collectively, the data show an apparent impact of both PD-1 affinity and IL-15 potency on PK. For instance, as illustrated in FIG. 107, XENP30290 which has the highest PD-1 affinity and higher IL-15 potency resulted in faster clearance than both XENP30291 and XENP29439 which have lower PD-1 affinity. However, XENP30516 which has the highest PD-1 affinity, but lower IL-15 potency resulted in slower clearance than XENP30290. This same trend is illustrated in FIG. 111 for XENP30362 and XENP30518 which are αRSV-targeted IL-15/Rα-Fc fusions respectively having higher and lower IL-15 potency. Notably, there did not appear to be any apparent difference in PK for test articles comprising IL-15 [N4D/N65D] and comprising IL-15[D30N/N65D].

Finally, FIG. 112 depicts PD1 expression on various lymphocyte populations following treatment with XENP30290, XENP30516, and XENP30362. The data show that PD-1-targeted IL-15/Rα-Fc fusions increase PD-1 expression. FIG. 113 shows the correlation between peak fold expansion of all T cell memory subsets and peak PD-1 expression. While the implications of this may require further investigation, the increased PD-1 expression may provide a positive feedback loop for enhanced effect from the PD-1-targeted IL-15/Rα-Fc fusions.

In another in vivo study in cynomolgus monkeys, the in vivo selectivity of PD-1-targeted IL-15/Rα-Fc fusions conferred by different IL-15 variants were investigated. Cynomolgus monkeys (n=3) were acclimated for 13 days (starting on Day −13), followed by intravenous administration of the indicated PD-1-targeteed (and control RSV-targeted)

reduced potency IL-15/Rα-Fc fusions at various dose concentrations (1× low dose, 3× intermediate dose, 10× high dose, or 30× very high dose). Blood was drawn throughout the study to investigate both pharmacokinetics and pharmacodynamics, data for which are depicted in FIGS. 114-119.

The following observations were made: XENP30290 induced PD1+ cell expansion at 1× low dose (FIG. 114); XENP30290 induced good PD1+ cell expansion at 10× high dose but has moderate activity on PD1-cells as shown by the activity of RSV-targeted control XENP30362 (FIG. 115); XENP30516 induced good PD1+ cell expansion at 10× high dose with good selectivity (FIG. 116); and XENP30516 induced greater PD1+ expansion at 30× very high dose while maintaining excellent selectivity (FIG. 117). Collectively, the data show that increasing dose results in higher selectivity. In addition, PD-1-targeted IL-15/Rα-Fc fusions comprising IL-15[D30N/E64Q/N65D] variant were more selective than PD-1-targeted IL-15/Rα-Fc fusions comprising IL-15[N4D/N65D] variant.

N. Example 14: PD-1-Targeted IL-15 Reverses Suppression of T Cell Proliferation In addition to proliferating effector T cells, IL-15 can also bind receptors on Tregs and enhance their proliferation; however, Tregs suppress the immune response are therefore thought to be unfavorable for oncology treatment.

It has been previously reported that rapamycin promotes proliferation of CD4+CD25+FOXP3+ Tregs in vitro, and resulting expanded Tregs suppress CD4+ and CD8+ T cell proliferation (see, for example, Battaglia et al. (2006) Rapamycin promotes expansion of functional CD4+CD25+FOXP3+ regulatory T cells of both healthy subjects and type 1 diabetic patients. J Immunol. 177(12) 8338-8347; and Strauss et al. (2007) Selective survival of naturally occurring human CD4+CD25+Foxp3+ regulatory T cells cultured with rapamycin. J Immunol. 178(1) 320-329). Accordingly, for experiments herein investigating the relationship between IL-15, Tregs, and other T cells, rapamycin-expanded Tregs were used. CD4+ T cells were enriched from human PBMCs by negative selection using EasySep™ Human CD4+ T Cell Enrichment Kit (STEMCELL Technologies, Vancouver, Canada). Treg were expanded using Dynabeads™ Human Treg Expander (Thermo Fisher Scientific, Waltham, Mass.) in RPMI1640+10% fetal bovine serum+0.1 µg/ml rapamycin+500 U/ml IL-2 for 1-4 days. Tregs were transferred to T75 flasks coated with 0.5 µg/ml anti-CD3 (OKT3, Biolegend, San Diego, Calif.) and cultured with RPMI1640+10% fetal bovine serum+0.1 µg/ml rapamycin+500 U/ml IL-2+0.5 µg/ml anti-CD28 mAb. Experiments utilizing rapamycin-expanded Tregs were performed at least 8 days after initial enrichment of CD4+ T cells from PBMCs.

1. 14A: PD-1-Targeted IL-15/Rα-Fc Fusions Reduce Proliferation of Tregs

To investigate the proliferation of Tregs by IL-15, 1.25×105 Tag-it Violet labeled Tregs were incubated with indicated doses of illustrative IL-15/Rα-Fc fusions XENP20818 (WT IL-15) or XENP24045 (IL-15[D30N/E64Q/N65D]) (sequences depicted in FIG. 120) as well as illustrative PD-1-targeted IL-15/Rα-Fc fusions in RPMI with 10% fetal bovine serum (without any other supplements) for 4 days. Data as depicted in FIG. 121 show that the IL-15/Rα-Fc fusions (targeted and untargeted) do induce proliferation of the rapamycin-expanded Tregs. Notably, the PD-1-targeted IL-15/Rα-Fc fusions were much less potent in inducing proliferation of Tregs in comparison to untargeted IL-15/Rα-Fc fusions.

2. 14B: PD-1-Targeted IL-15/Rα-Fc Fusions Enhance Effector T Cell Proliferation and Reduce Treg Suppression 1×10⁵ CFSE-labeled PBMCs (fixed number) were seeded with indicated ratio of Tag-it Violet labeled rapamycin-expanded Tregs, and 5 µg/ml of illustrative targeted IL-15/Rα-Fc fusions on plate bound anti-CD3 (OKT3; 100 ng/ml). After 4 days incubation at 37° C., cells were analyzed by flow cytometry. Proliferation was measured by CFSE (for T cells) or Tag-it Violet (for Tregs) dilution and Zombie dye was used to exclude dead cells.

Figure 122B:
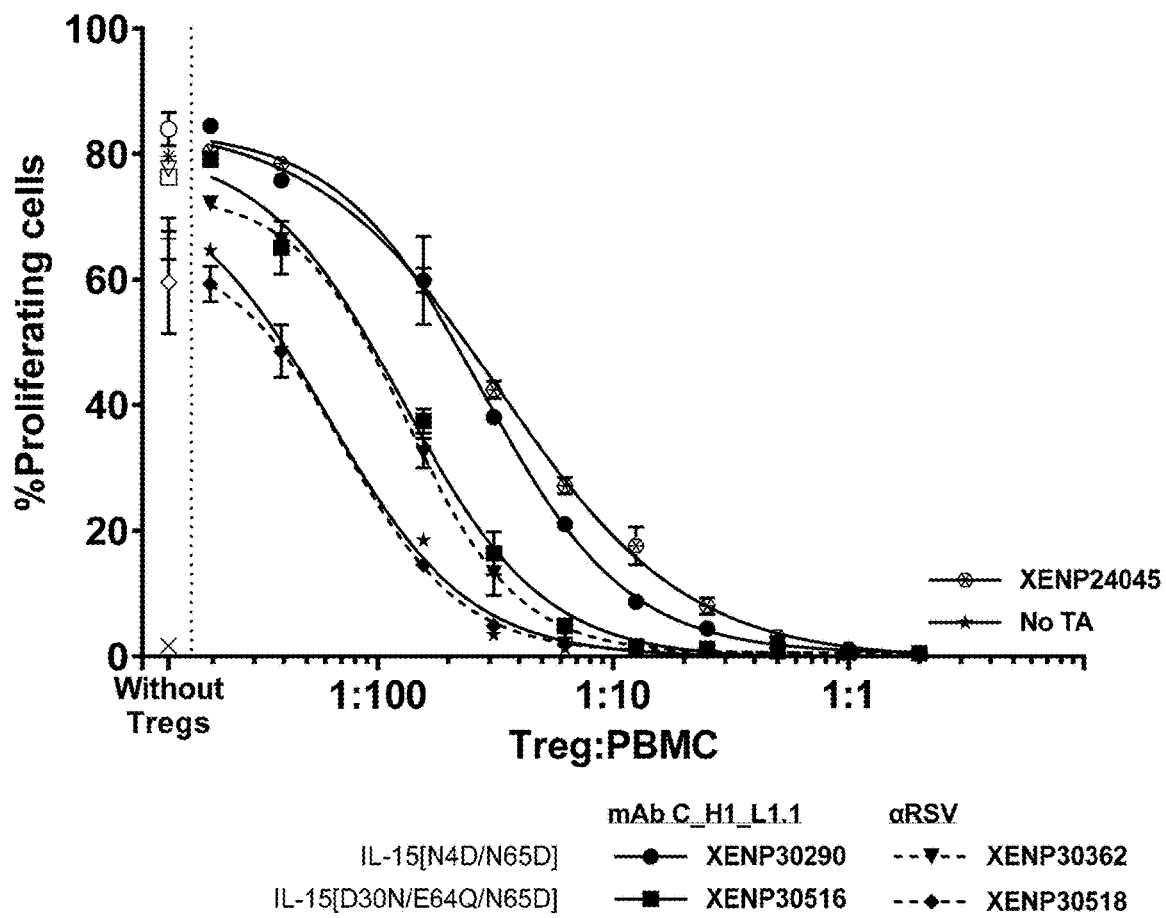

The data as depicted in FIG. 122 show that the PD-1-targeted IL-15/Rα-Fc fusions shifted (reduced) the potency of Treg-induced suppression of CD8 and CD4 effector memory T cell proliferation. Notably, the shift by control RSV-targeted IL-15/Rα-Fc fusions was less than the reduction in potency induced by the PD-1-targeted IL-15/Rα-Fc fusions (again, indicating that this should be a very tumor environment-specific effect).

The data as depicted in FIG. 123 show the ratio of Treg/CD8 TEM and Treg/CD4 TEM ell counts. The data show that in comparison to no test articles, the PD-1-targeted IL-15/Rα-Fc fusions increased the Treg/TEM ratio, and yet TEM cell proliferation is enhanced by the PD-1-targeted IL-15/Rα-Fc fusions. This indicates that although Tregs are expanded, the expanded Tregs notably demonstrate decreased suppressive capacity.

3. 14C: Mechanism for Reduced Suppression of T Cell Proliferation a. 14C(a): Tregs Treated with IL-15/Rα-Fc Fusion Show Reduced eTreg Population Over Time In a first experiment to investigate the mechanism for reduced suppression, Tregs were either grown for 6 days in a) complete Treg media (RPMI with 10% FBS, 0.5 µg/ml anti-CD28, 100 U/ml IL-2, 100 ng/ml rapamycin), b) complete Treg media without rapamycin, or c) with 100 ng/ml IL-15 (in RPMI with 10% FBS, 0.5 µg/ml anti-CD28; no IL-2; no rapamycin). 1×105 CFSE-labeled PBMCs were seeded with indicated dose of Tag-it Violet labeled Tregs on plate bound anti-CD3 (OKT3; 100 ng/ml). Proliferation of CD8+ and CD4+ T cells were determined, data for which are depicted in FIG. 124. The data show that Tregs pre-treated with IL-15 show impaired suppressive capacity, suggesting that IL-15 converts Tregs to a less immunosuppressive phenotype.

To further investigate this observation, rapamycin-expanded Tregs were treated with IL-15/Rα-Fc fusion XENP22821 (IL-15[N65D]; sequence depicted in FIG. 120) for 14 days, and analyzed by flow cytometry. Surprisingly, the data in FIG. 125 depicting expression of CD25 and FOXP3 on CD4+ cells show that treatment with XENP22821 reduced FOXP3 expression. While FOXP3 is generally a marker for Tregs, FOXP3high CD4+CD45RA− are the truly suppressive eTreg while FOXP3low CD4+CD45RA− are nonsuppressive activated effector CD4 T cells (Miyara et al. (2009) Functional delineation and differentiation dynamics of human CD4+ T cells expressing the FoxP3 transcription factor. Immunity. 30(6):899-911). The data in FIG. 126 depicting expression of CD45RA and FOXP3 on CD4+ cells show that treatment with XENP22821 shifts CD4+CD45RA− populations from FoxP3high to FoxP3low, indicating that treatment with IL-15/Rα-Fc fusions actually shifted population from eTreg (decreased population from 5.24% to 2.72%) to activated effector CD4 T cells (increased population from 18.2% to 28.6%).

In addition, the data in FIG. 127 depicting expression of CD25 and CCR4 on CD4+ cells show that treatment with XENP22821 reduced CCR4 expression. It has previously been reported that CCR4 is involved with immunosuppression (Molinaro et al. (2015) CCR4 Controls the Suppressive Effects of Regulatory T Cells on Early and Late Events during Severe Sepsis. PLoS One. 10(7)).

Collectively, this indicates that although IL-15/Rα-Fc fusions (untargeted and targeted) expand existing Treg populations, they reverse suppression of effector T cell proliferation by expanding Tregs into non-immunosuppressive phenotypes (e.g. FoxP3low and CCR4low/−).

b. 14C(b): IL-15/Rα-Fc Fusions Reverse TGFβ Suppression of T Cell Proliferation

In the tumor environment, TGFβ is expressed both by malignant cells as well as by immune cells (e.g. Tregs), and function to suppress T cell proliferation resulting in suppressed antitumor immune response (Teicher, B A. (2007) Transforming Growth Factor-β and the Immune Response to Malignant Disease. Clin Cancer Res. 13(21)).

In an experiment to investigate the interplay between IL-15/Rα-Fc fusions and TGFβ, CFSE-labeled PBMCs were incubated with indicated dose of TGFβ1, with or without 10 μg/ml illustrative IL-15/Rα-Fc fusion XENP24045 on 100 ng/ml plate-bound anti-CD3 (OKT3) for 4 days at 37° C. After 4 days, cells were analyzed by flow cytometry. Proliferation of T cells was measured by CFSE dilution, data for which are depicted in FIG. 128. The data shows that TGFβ dose-dependently suppresses proliferation of T cells; however, notably, IL-15/Rα-Fc fusion prevents TGFβ suppression of T cell proliferation at all doses tested.

This indicates that another mechanism by which the PD-1-targeted IL-15/Rα-Fc fusions reverse suppression of T cell proliferation is by reversing the suppressive actions of TGFβ.

SEQUENCE LISTING (632 sequences)

SEQ ID NO: 1 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 4 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 5 - protein, 119 aa, Artificial Sequence
  Description of Artificial Sequence: Synthetic polypeptide
  mAb C[PD-1]_H1
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 6 - protein, 113 aa, Artificial Sequence
  Description of Artificial Sequence: Synthetic polypeptide
  mAb C[PD-1]_L1
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 7 - protein, 4 aa, Artificial Sequence
  Description of Artificial Sequence: Synthetic peptide
EPKS

SEQ ID NO: 8 - protein, 2 aa, Artificial Sequence
  Description of Artificial Sequence: Synthetic peptide
GS

SEQ ID NO: 9 - protein, 5 aa, Artificial Sequence
  Description of Artificial Sequence: Synthetic peptide
GSGGS

SEQ ID NO: 10 - protein, 5 aa, Artificial Sequence
  Description of Artificial Sequence: Synthetic peptide
GGGGS

SEQ ID NO: 11 - protein, 4 aa, Artificial Sequence
  Description of Artificial Sequence: Synthetic peptide
GGGS

SEQ ID NO: 12 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 13 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 14 - protein, 214 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 15 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 16 - protein, 240 aa, Homo sapiens
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 17 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 18 - protein, 150 aa, Homo sapiens [sequence omitted]

SEQ ID NO: 19 - protein, 288 aa, Macaca fascicularis
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 20 - protein, 150 aa, Macaca fascicularis
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 21 - protein, 10 aa, Artificial Sequence
  Description of Artificial Sequence: Synthetic peptide
GGGGSGGGGS

SEQ ID NO: 22 - protein, 15 aa, Artificial Sequence
  Description of Artificial Sequence: Synthetic peptide
GGGGSGGGGSGGGGS

SEQ ID NO: 23 - protein, 20 aa, Artificial Sequence
  Description of Artificial Sequence: Synthetic peptide
GGGGSGGGGSGGGGSGGGGS

SEQ ID NO: 24 - protein, 25 aa, Artificial Sequence
  Description of Artificial Sequence: Synthetic peptide
GGGGSGGGGSGGGGSGGGGSGGGGS

SEQ ID NO: 25 - protein, 30 aa, Artificial Sequence
  Description of Artificial Sequence: Synthetic polypeptide
GGGGSGGGGSGGGGSGGGGSGGGGSGGGGS

SEQ ID NO: 26 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 27 - protein, 30 aa, Artificial Sequence
  Description of Artificial Sequence: Synthetic polypeptide
DPALVHQRPAPPGGGGSGGGGSGGGGSGGG

SEQ ID NO: 28 - protein, 5 aa, Artificial Sequence
  Description of Artificial Sequence: Synthetic peptide
GKPGS

SEQ ID NO: 29 - protein, 25 aa, Artificial Sequence
  Description of Artificial Sequence: Synthetic peptide
GKPGSGKPGSGKPGSGKPGSGKPGS

SEQ ID NO: 30 - protein, 30 aa, Artificial Sequence
  Description of Artificial Sequence: Synthetic polypeptide
GKPGSGKPGSGKPGSGKPGSGKPGSGKPGS

SEQ ID NO: 31 - protein, 5 aa, Artificial Sequence
  Description of Artificial Sequence: Synthetic peptide
GGGES

SEQ ID NO: 32 - protein, 18 aa, Artificial Sequence
  Description of Artificial Sequence: Synthetic peptide
GSTSGSGKPGSGEGSTKG

SEQ ID NO: 33 - protein, 14 aa, Artificial Sequence
  Description of Artificial Sequence: Synthetic peptide
IRPRAIGGSKPRVA

SEQ ID NO: 34 - protein, 15 aa, Artificial Sequence
  Description of Artificial Sequence: Synthetic peptide
GKGGSGKGGSGKGGS

SEQ ID NO: 35 - protein, 15 aa, Artificial Sequence
  Description of Artificial Sequence: Synthetic peptide
GGKGSGGKGSGGKGS

SEQ ID NO: 36 - protein, 15 aa, Artificial Sequence
  Description of Artificial Sequence: Synthetic peptide
GGGKSGGGKSGGGKS

SEQ ID NO: 37 - protein, 15 aa, Artificial Sequence
  Description of Artificial Sequence: Synthetic peptide
GKGKSGKGKSGKGKS

SEQ ID NO: 38 - protein, 15 aa, Artificial Sequence
  Description of Artificial Sequence: Synthetic peptide
GGGKSGGKGSGKGGS

SEQ ID NO: 39 - protein, 15 aa, Artificial Sequence
  Description of Artificial Sequence: Synthetic peptide
GKPGSGKPGSGKPGS

SEQ ID NO: 40 - protein, 20 aa, Artificial Sequence
  Description of Artificial Sequence: Synthetic peptide
GKPGSGKPGSGKPGSGKPGS

SEQ ID NO: 41 - protein, 20 aa, Artificial Sequence
  Description of Artificial Sequence: Synthetic peptide
GKGKSGKGKSGKGKSGKGKS

SEQ ID NO: 42 - protein, 14 aa, Artificial Sequence
  Description of Artificial Sequence: Synthetic peptide
STAGDTHLGGEDFD

SEQ ID NO: 43 - protein, 15 aa, Artificial Sequence
  Description of Artificial Sequence: Synthetic peptide
GEGGSGEGGSGEGGS

SEQ ID NO: 44 - protein, 15 aa, Artificial Sequence
  Description of Artificial Sequence: Synthetic peptide
GGEGSGGEGSGGEGS

SEQ ID NO: 45 - protein, 15 aa, Artificial Sequence
  Description of Artificial Sequence: Synthetic peptide
GGGESGGGESGGGES

SEQ ID NO: 46 - protein, 15 aa, Artificial Sequence
  Description of Artificial Sequence: Synthetic peptide
GEGESGEGESGEGES

SEQ ID NO: 47 - protein, 15 aa, Artificial Sequence
  Description of Artificial Sequence: Synthetic peptide
GGGESGGEGSGEGGS

SEQ ID NO: 48 - protein, 20 aa, Artificial Sequence
  Description of Artificial Sequence: Synthetic peptide
GEGESGEGESGEGESGEGES

SEQ ID NO: 49 - protein, 19 aa, Artificial Sequence
  Description of Artificial Sequence: Synthetic peptide
PRGASKSGSASQTGSAPGS

SEQ ID NO: 50 - protein, 19 aa, Artificial Sequence
  Description of Artificial Sequence: Synthetic peptide
GTAAAGAGAAGGAAAGAAG

SEQ ID NO: 51 - protein, 19 aa, Artificial Sequence
  Description of Artificial Sequence: Synthetic peptide
GTSGSSGSGSGGSGSGGGG

SEQ ID NO: 52 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 54 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 231 aa, Artificial Sequence; identical to SEQ ID NO: 53
  Description of Artificial Sequence: Synthetic polypeptide
  IL-15/Ralpha-Fc monomer 2

SEQ ID NO: 56 - protein, 231 aa, Artificial Sequence; identical to SEQ ID NO: 54
  Description of Artificial Sequence: Synthetic polypeptide
  IL-15/Ralpha-Fc monomer 1

SEQ ID NO: 57 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 58 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 59 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 60 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 62 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 64 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 66 - protein, 229 aa, Artificial Sequence
  Description of Artificial Sequence: Synthetic polypeptide
  IL-15/Ralpha-Fc monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 67 - protein, 229 aa, Artificial Sequence
  Description of Artificial Sequence: Synthetic polypeptide
  IL-15/Ralpha-Fc monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 68 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 69 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 70 - protein, 228 aa, Artificial Sequence
  Description of Artificial Sequence: Synthetic polypeptide
  IL-15/Ralpha-Fc monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 71 - protein, 228 aa, Artificial Sequence
  Description of Artificial Sequence: Synthetic polypeptide
  IL-15/Ralpha-Fc monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 72 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 73 - protein, 231 aa, Artificial Sequence
  Description of Artificial Sequence: Synthetic polypeptide
  IL-15/Ralpha-Fc monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 74 - protein, 231 aa, Artificial Sequence
  Description of Artificial Sequence: Synthetic polypeptide
  IL-15/Ralpha-Fc monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 231 aa, Artificial Sequence; identical to SEQ ID NO: 74
  Description of Artificial Sequence: Synthetic polypeptide
  IL-15/Ralpha-Fc monomer 2

SEQ ID NO: 76 - protein, 231 aa, Artificial Sequence; identical to SEQ ID NO: 53
  Description of Artificial Sequence: Synthetic polypeptide
  IL-15/Ralpha-Fc monomer 1

SEQ ID NO: 77 - protein, 231 aa, Artificial Sequence
  Description of Artificial Sequence: Synthetic polypeptide
  IL-15/Ralpha-Fc monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 329 aa, Artificial Sequence
  Description of Artificial Sequence: Synthetic polypeptide
  Chain 1 IL-15/Ralpha x anti-PD-1 Backbone 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 231 aa, Artificial Sequence; identical to SEQ ID NO: 53
  Description of Artificial Sequence: Synthetic polypeptide
  Chain 2 IL-15/Ralpha x anti-PD-1 Backbone 1

SEQ ID NO: 80 - protein, 329 aa, Artificial Sequence
  Description of Artificial Sequence: Synthetic polypeptide
  Chain 1 IL-15/Ralpha x anti-PD-1 Backbone 2
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 81 - protein, 231 aa, Artificial Sequence; identical to SEQ ID NO: 52
  Description of Artificial Sequence: Synthetic polypeptide
  Chain 2 IL-15/Ralpha x anti-PD-1 Backbone 2

SEQ ID NO: 82 - protein, 329 aa, Artificial Sequence; identical to SEQ ID NO: 80
  Description of Artificial Sequence: Synthetic polypeptide
  Chain 1 IL-15/Ralpha x anti-PD-1 Backbone 3

SEQ ID NO: 83 - protein, 329 aa, Artificial Sequence
  Description of Artificial Sequence: Synthetic polypeptide
  Chain 2 IL-15/Ralpha x anti-PD-1 Backbone 3
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 107 aa, Artificial Sequence [sequence omitted]

SEQ ID NO: 85 - protein, 106 aa, Artificial Sequence
  Description of Artificial Sequence: Synthetic polypeptide
  Constant Light Chain Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 86 - protein, 350 aa, Artificial Sequence
  Description of Artificial Sequence: Synthetic polypeptide
  XENP20818 Chain 1 - human_IL15_(GGGGS)1_Fc(216) _IgG1_pI(-)_Isosteric_A_C220S/PVA_/S267K/L368D/K370S
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 87 - protein, 301 aa, Artificial Sequence
  Description of Artificial Sequence: Synthetic polypeptide
  XENP20818 Chain 2 - human_IL15Ralpha(Sushi)_ (GGGGS)1_Fc(216)_IgG1_C220S/PVA_/S267K/S364K/E357Q
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 350 aa, Artificial Sequence
  Description of Artificial Sequence: Synthetic polypeptide
  XENP22853 Chain 1 - human_IL15_(GGGGS)1-Fc(216) _IgG1_pI(-)_Isosteric_A_C220S/PVA_/S267K/L368D/ K370S/M428L/N434S
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 89 - protein, 301 aa, Artificial Sequence
  Description of Artificial Sequence: Synthetic polypeptide
  XENP22853 Chain 2 - human_IL15Ra(Sushi)_(GGGGS)1- Fc(216) _IgG1_C220S/PVA_/S267K/S364K/E357Q/M428L/N434S
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 90 - protein, 440 aa, Artificial Sequence
  Description of Artificial Sequence: Synthetic polypeptide
  XENP21478 Chain 1 - human_IL15Ralpha(sushi)_(GGGGS)6 -human_IL15-Fc(216)_IgG1_pI(-)_Isosteric_A_C220S/PVA _/S267K/L368D/K370S (16478)
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 91 - protein, 231 aa, Artificial Sequence; identical to SEQ ID NO: 52
  Description of Artificial Sequence: Synthetic polypeptide
  XENP21478 Chain 2 - empty-Fc(216)_IgG1_C220S/PVA_/S267K /S364K/E357Q (8924)

SEQ ID NO: 92 - protein, 435 aa, Artificial Sequence
  Description of Artificial Sequence: Synthetic polypeptide
  XENP021993 Chain 1 - human_IL15Ra(sushi)_(GGGGS)5-human _IL15(single-chain)_Fc(216)_IgG1_pI(-)_Isosteric_A_C220S /PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 93 - protein, 231 aa, Artificial Sequence; identical to SEQ ID NO: 52
  Description of Artificial Sequence: Synthetic polypeptide
  XENP021993 Chain 2 empty_Fc(216)_IgG1_C220S/PVA_/S267K/ S364K/E357Q

SEQ ID NO: 94 - protein, 114 aa, Artificial Sequence; identical to SEQ ID NO: 2
  Description of Artificial Sequence: Synthetic polypeptide
  XENP21479 Chain 1 - human_IL15_no_tag (16484)

SEQ ID NO: 95 - protein, 231 aa, Artificial Sequence; identical to SEQ ID NO: 53
  Description of Artificial Sequence: Synthetic polypeptide
  XENP21479 Chain 2 - empty-Fc(216)_IgG1_pI(-) _Isosteric_A_C220S/PVA_/S267K/L368D/K370S (8793)

SEQ ID NO: 96 - protein, 296 aa, Artificial Sequence
  Description of Artificial Sequence: Synthetic polypeptide
  XENP21479 Chain 3 - human_IL15Ralpha(Sushi)-Fc(216) _IgG1_C220S/PVA_/S267K/S364K/E357Q (16481)
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 114 aa, Artificial Sequence
  Description of Artificial Sequence: Synthetic polypeptide
  N1D
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 98 - protein, 114 aa, Artificial Sequence
  Description of Artificial Sequence: Synthetic polypeptide
  N4D
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 99 - protein, 114 aa, Artificial Sequence
  Description of Artificial Sequence: Synthetic polypeptide
  D8N
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 100 - protein, 114 aa, Artificial Sequence
  Description of Artificial Sequence: Synthetic polypeptide
  D30N
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 101 - protein, 114 aa, Artificial Sequence
  Description of Artificial Sequence: Synthetic polypeptide
  D61N
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 102 - protein, 114 aa, Artificial Sequence
  Description of Artificial Sequence: Synthetic polypeptide
  E64Q
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 103 - protein, 114 aa, Artificial Sequence
  Description of Artificial Sequence: Synthetic polypeptide
  N65D
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 104 - protein, 114 aa, Artificial Sequence
  Description of Artificial Sequence: Synthetic polypeptide
  Q108E
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 105 - protein, 114 aa, Artificial Sequence
  Description of Artificial Sequence: Synthetic polypeptide
  N1D/D61N
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 106 - protein, 114 aa, Artificial Sequence
  Description of Artificial Sequence: Synthetic polypeptide
  N1D/E64Q
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 107 - protein, 114 aa, Artificial Sequence
  Description of Artificial Sequence: Synthetic polypeptide
  N4D/D61N
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 108 - protein, 114 aa, Artificial Sequence
  Description of Artificial Sequence: Synthetic polypeptide
  N4D/E64Q
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 109 - protein, 114 aa, Artificial Sequence
  Description of Artificial Sequence: Synthetic polypeptide
  D8N/D61N
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 110 - protein, 114 aa, Artificial Sequence
  Description of Artificial Sequence: Synthetic polypeptide
  D8N/E64Q
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 111 - protein, 114 aa, Artificial Sequence
  Description of Artificial Sequence: Synthetic polypeptide
  D61N/E64Q
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTS

SEQ ID NO: 112 - protein, 114 aa, Artificial Sequence
  Description of Artificial Sequence: Synthetic polypeptide
  E64Q/Q108E
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTS

SEQ ID NO: 113 - protein, 114 aa, Artificial Sequence
  Description of Artificial Sequence: Synthetic polypeptide
  N1D/N4D/D8N
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 114 - protein, 114 aa, Artificial Sequence
  Description of Artificial Sequence: Synthetic polypeptide
  D61N/E64Q/N65D
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTS

SEQ ID NO: 115 - protein, 114 aa, Artificial Sequence
  Description of Artificial Sequence: Synthetic polypeptide
  N1D/D61N/E64Q/Q108E
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 116 - protein, 114 aa, Artificial Sequence
  Description of Artificial Sequence: Synthetic polypeptide
  N4D/D61N/E64Q/Q108E
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 117 - protein, 114 aa, Artificial Sequence
  Description of Artificial Sequence: Synthetic polypeptide
  N1D/N65D
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 118 - protein, 114 aa, Artificial Sequence
  Description of Artificial Sequence: Synthetic polypeptide
  N1D/Q108E
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 119 - protein, 114 aa, Artificial Sequence
  Description of Artificial Sequence: Synthetic polypeptide
  N4D/N65D
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 120 - protein, 114 aa, Artificial Sequence
  Description of Artificial Sequence: Synthetic polypeptide
  N1D/D30N
DWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 121 - protein, 114 aa, Artificial Sequence
  Description of Artificial Sequence: Synthetic polypeptide
  N4D/D30N
NWVDVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 122 - protein, 114 aa, Artificial Sequence
  Description of Artificial Sequence: Synthetic polypeptide
  D30N/E64Q
NWVNVISDLKKIEDLIQSMHIDATLYTESNVHPSCKVTAMKCFLLELQVISLESGDASIHDTVQNLIILANNSLSSNGNVTESGCKECEELEEKNIKEFLQSFVHIVQMFINTS

SEQ ID NO: 123 - protein, 114 aa, Artificial Sequence
  Description of Artificial Sequence: Synthetic polypeptide
  D30N/N65D
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTS

SEQ ID NO: 124 - protein, 114 aa, Artificial Sequence
  Description of Artificial Sequence: Synthetic polypeptide
  D30N/Q108E
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTS

SEQ ID NO: 125 - protein, 114 aa, Artificial Sequence
  Description of Artificial Sequence: Synthetic polypeptide
  N65D/Q108E
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTS

SEQ ID NO: 126 - protein, 114 aa, Artificial Sequence
  Description of Artificial Sequence: Synthetic polypeptide
  E64Q/N65D
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTS

SEQ ID NO: 127 - protein, 114 aa, Artificial Sequence
  Description of Artificial Sequence: Synthetic polypeptide
  N1D/N4D/N65D
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 128 - protein, 114 aa, Artificial Sequence
  Description of Artificial Sequence: Synthetic polypeptide
  D30N/E64Q/N65D
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTS

SEQ ID NO: 129 - protein, 114 aa, Artificial Sequence
  Description of Artificial Sequence: Synthetic polypeptide
  N4D/D61N/N65D
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTS

SEQ ID NO: 130 - protein, 350 aa, Artificial Sequence
  Description of Artificial Sequence: Synthetic polypeptide
  XENP24113 Chain 1 - human_IL15_N4D/N65D_(GGGGS)1-Fc(216) _IgG1_pI(-)_Isosteric_A_C220S/PVA_/S267K/L368D/K370S/ M428L/N434S
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 131 - protein, 301 aa, Artificial Sequence; identical to SEQ ID NO: 89
  Description of Artificial Sequence: Synthetic polypeptide
  XENP24113 Chain 2 - human_IL15Ra(Sushi)_(GGGGS)1-Fc(216) _IgG1_C220S/PVA_/S267K/S364K/E357Q/M428L/N434S

SEQ ID NO: 132 - protein, 350 aa, Artificial Sequence
  Description of Artificial Sequence: Synthetic polypeptide
  XENP24306 Chain 1 - human_IL15_D30N/E64Q/N65D_(GGGGS)1 -Fc(216)_IgG1_pI(-)_Isosteric_A_C220S/PVA_/S267K/L368D/ K370S/M428L/N434S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 133 - protein, 301 aa, Artificial Sequence; identical to SEQ ID NO: 89
  Description of Artificial Sequence: Synthetic polypeptide
  XENP24306 Chain 2 - human_IL15Ra(Sushi)_(GGGGS)1- Fc(216)_IgG1_C220S/PVA_/S267K/S364K/E357Q/M428L/N434S

SEQ ID NO: 134 - protein, 435 aa, Artificial Sequence
  Description of Artificial Sequence: Synthetic polypeptide
  XENP29281 Chain 1 - human_IL15Ra(sushi)_(GGGGS)5- human_IL15_D30N_(single-Chain)-Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 135 - protein, 231 aa, Artificial Sequence; identical to SEQ ID NO: 52
  Description of Artificial Sequence: Synthetic polypeptide
  XENP29281 Chain 2 - empty-Fc(216)_IgG1_C220S/PVA_/ S267K/S364K/E357Q

SEQ ID NO: 136 - protein, 435 aa, Artificial Sequence
  Description of Artificial Sequence: Synthetic polypeptide
  XENP24050 Chain 1 - human_IL15Ra(sushi)_(GGGGS)5-human_ IL15_N4D/N65D_(single-Chain)-Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 137 - protein, 231 aa, Artificial Sequence; identical to SEQ ID NO: 52
  Description of Artificial Sequence: Synthetic polypeptide
  XENP24050 Chain 2 - empty-Fc(216)_IgG1_C220S/PVA_/ S267K/S364K/E357Q

SEQ ID NO: 138 - protein, 435 aa, Artificial Sequence
  Description of Artificial Sequence: Synthetic polypeptide
  XENP24294 Chain 1 - human_IL15Ra(sushi)_(GGGGS)5-human_ IL15_N4D/N65D_(single-Chain)-Fc(216)_IgG1_pI(-)_ Isosteric_A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 139 - protein, 231 aa, Artificial Sequence; identical to SEQ ID NO: 72
  Description of Artificial Sequence: Synthetic polypeptide
  XENP24294 Chain 2 - empty-Fc(216)_IgG1_C220S/PVA_/S267K/ S364K/E357Q/M428L/N434S

SEQ ID NO: 140 - protein, 435 aa, Artificial Sequence
  Description of Artificial Sequence: Synthetic polypeptide
  XENP29285 Chain 1 - human_IL15Ra(sushi)_(GGGGS)5-human_ IL15_D30N/N65D_(single-Chain)-Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 141 - protein, 231 aa, Artificial Sequence; identical to SEQ ID NO: 52
  Description of Artificial Sequence: Synthetic polypeptide
  XENP29285 Chain 2 - empty-Fc(216)_IgG1_C220S/PVA_/ S267K/S364K/E357Q

SEQ ID NO: 142 - protein, 435 aa, Artificial Sequence
  Description of Artificial Sequence: Synthetic polypeptide
  XENP29286 Chain 1 - human_IL15Ra(sushi)_(GGGGS)5-human_ IL15_D30N/E64Q/N65D_(single-Chain)-Fc(216)_IgG1_pI(-)_ Isosteric_A_C220S/PVA_/S267K/L368D/K370S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 143 - protein, 231 aa, Artificial Sequence; identical to SEQ ID NO: 52
  Description of Artificial Sequence: Synthetic polypeptide
  XENP29286 Chain 2 - empty-Fc(216)_IgG1_pI(-)_ Isosteric_A_C220S/PVA_/S267K/L368D/K370S

SEQ ID NO: 144 - protein, 449 aa, Artificial Sequence
  Description of Artificial Sequence: Synthetic polypeptide
  XENP015074 Numax_IgG1_PVA_/S267K Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 213 aa, Artificial Sequence
  Description of Artificial Sequence: Synthetic polypeptide
  XENP015074 Numax_IgG1_PVA_/S267K Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 442 aa, Artificial Sequence
  Description of Artificial Sequence: Synthetic polypeptide
  XENP016432 Nivolumab_H0L0_IgG1_PVA_/S267K Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 147 - protein, 214 aa, Artificial Sequence
  Description of Artificial Sequence: Synthetic polypeptide
  XENP016432 Nivolumab_H0L0_IgG1_PVA_/S267K Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 148 - protein, 447 aa, Artificial Sequence
  Description of Artificial Sequence: Synthetic polypeptide
  XENP021461 Pembrolizumab_H0L0_IgG4_S228P Heavy Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 149 - protein, 218 aa, Artificial Sequence
  Description of Artificial Sequence: Synthetic polypeptide
  XENP021461 Pembrolizumab_H0L0_IgG4_S228P Light Chain
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 449 aa, Artificial Sequence
  Description of Artificial Sequence: Synthetic polypeptide
  XENP28437 Chain 1 - Pembrolizumab_H0_IgG1_PVA_/S267K Heavy Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 218 aa, Artificial Sequence; identical to SEQ ID NO: 149
  Description of Artificial Sequence: Synthetic polypeptide
  XENP28437 Chain 2 - Pembrolizumab_L0 Light Chain

SEQ ID NO: 152 - protein, 446 aa, Artificial Sequence
  Description of Artificial Sequence: Synthetic polypeptide
  XENP021575 1C11[PD-1]_H0L0_IgG1_PVA_/S267K Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 219 aa, Artificial Sequence
  Description of Artificial Sequence: Synthetic polypeptide
  XENP021575 1C11[PD-1]_H0L0_IgG1_PVA_/S267K Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 154 - protein, 446 aa, Artificial Sequence
  Description of Artificial Sequence: Synthetic polypeptide
  XENP022553 1C11[PD-1]_H3L3_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 219 aa, Artificial Sequence
  Description of Artificial Sequence: Synthetic polypeptide
  XENP022553 1C11[PD-1]_H3L3_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 156 - protein, 448 aa, Artificial Sequence
  Description of Artificial Sequence: Synthetic polypeptide
  XENP28519 Chain 1 - mAb A[PD-1]_H1_IgG1_PVA_/S267K Heavy Chain
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 214 aa, Artificial Sequence
  Description of Artificial Sequence: Synthetic polypeptide
  XENP28519 Chain 2 - mAb A[PD-1]_L1 Light Chain
DIQMTQSPSSLSASVGDRVTITCRASENIHNYLAWYQQKPGKSPKLLVYNVKTLADGVPSRFSGSGSGTDYTLTISSLQPEDFATYYCQHFWSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 446 aa, Artificial Sequence
  Description of Artificial Sequence: Synthetic polypeptide
  XENP28686 Chain 1 - mAb B[PD-1]_H1_IgG1_PVA_/S267K Heavy Chain
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 214 aa, Artificial Sequence
  Description of Artificial Sequence: Synthetic polypeptide
  XENP28686 Chain 2 - mAb B[PD-1]_L1 Light Chain
DIQMTQSPSSLSASVGDRVTITCRASQGISGDLNWYQQKPGKTVKLLIYHTSSLHSGVPLRFSGSGSGTDYTLTISSLQPEDFATYYCQYYSKDLLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 446 aa, Artificial Sequence
  Description of Artificial Sequence: Synthetic polypeptide
  XENP025850 Chain 1 - 1C11[PD-1]_H3L3_ IgG1_PVA_/S267K/ S364K/E357Q
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 435 aa, Artificial Sequence; identical to SEQ ID NO: 136
  Description of Artificial Sequence: Synthetic polypeptide
  XENP025850 Chain 2 - human_IL15Ra(sushi)_(GGGGS)5-human_ IL15(N4D/N65D;single-chain)_ Fc(216)_IgG1_pI(-)_ Isosteric_A_C220S/PVA_/S267K/L368D/K370S

SEQ ID NO: 162 - protein, 219 aa, Artificial Sequence; identical to SEQ ID NO: 155
  Description of Artificial Sequence: Synthetic polypeptide
  XENP025850 Chain 3 - 1C11[PD-1]_L3

SEQ ID NO: 163 - protein, 435 aa, Artificial Sequence; identical to SEQ ID NO: 138
  Description of Artificial Sequence: Synthetic polypeptide
  Chain 1 - XENP025937 human_IL15Ra(sushi)_(GGGGS)5-human_ IL15(N4D/N65D;single-Chain)_Fc(216)_IgG1_pI(-)_ Isosteric_A_C220S/PVA_/S267K/L368D/K370S/M428L/N434S

SEQ ID NO: 164 - protein, 446 aa, Artificial Sequence
  Description of Artificial Sequence: Synthetic polypeptide
  Chain 2 - XENP025937 1C11[PD-1]_H3L3_IgG1_PVA_/S267K/ S364K/E357Q/M428L/N434S
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 165 - protein, 219 aa, Artificial Sequence; identical to SEQ ID NO: 155
  Description of Artificial Sequence: Synthetic polypeptide
  Chain 3 - XENP025937 1C11[PD-1]_L3

SEQ ID NO: 166 - protein, 435 aa, Artificial Sequence; identical to SEQ ID NO: 136
  Description of Artificial Sequence: Synthetic polypeptide
  XENP28532 Chain 1 - human_IL15Ra(sushi)_(GGGGS)5-human_ IL15(N4D/N65D;single-Chain)_Fc(216)_IgG1_pI(-)_ Isosteric_A_C220S/PVA_/S267K/L368D/K370S scIL-15/Ralpha-Fc Chain

SEQ ID NO: 167 - protein, 448 aa, Artificial Sequence
  Description of Artificial Sequence: Synthetic polypeptide
  XENP28532 Chain 2 - mAb A[PD-1]_H1_IgG1_PVA_/S267K/ S364K/E357Q Heavy Chain
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 214 aa, Artificial Sequence; identical to SEQ ID NO: 157
  Description of Artificial Sequence: Synthetic polypeptide
  XENP28532 Chain 3 - mAb A[PD-1]_L1 Light Chain

SEQ ID NO: 169 - protein, 435 aa, Artificial Sequence; identical to SEQ ID NO: 136
  Description of Artificial Sequence: Synthetic polypeptide
  XENP28692 Chain 1 - human_IL15Ra(sushi)_(GGGGS)5-human_ IL15(N4D/N65D;single-Chain)_Fc(216)_IgG1_pI(-)_ Isosteric_A_C220S/PVA_/S267K/L368D/K370S scIL-15/Ralpha-Fc Chain

SEQ ID NO: 170 - protein, 446 aa, Artificial Sequence
  Description of Artificial Sequence: Synthetic polypeptide
  XENP28692 Chain 2 - mAb B[PD-1]_H1_IgG1_PVA_/S267K/ S364K/E357Q Heavy Chain
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 214 aa, Artificial Sequence; identical to SEQ ID NO: 159
  Description of Artificial Sequence: Synthetic polypeptide
  XENP28692 Chain 3 - mAb B[PD-1]_L1 Light Chain

SEQ ID NO: 172 - protein, 435 aa, Artificial Sequence; identical to SEQ ID NO: 142
  Description of Artificial Sequence: Synthetic polypeptide
  XENP30455 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S

SEQ ID NO: 173 - protein, 448 aa, Artificial Sequence; identical to SEQ ID NO: 167
  Description of Artificial Sequence: Synthetic polypeptide
  XENP30455 Chain 2 -  mAb A[PD-1]_H1L1_IgG1_Fc(216)_ IgG1_pI(-)_Isosteric_A_C220S/PVA_/S267K/L368D/K370S- IgG1_PVA_/S267K/S364K/E357Q

SEQ ID NO: 174 - protein, 214 aa, Artificial Sequence; identical to SEQ ID NO: 157
  Description of Artificial Sequence: Synthetic polypeptide
  XENP30455 Chain 3 -  mAb A[PD-1]_L1

SEQ ID NO: 175 - protein, 435 aa, Artificial Sequence; identical to SEQ ID NO: 138
  Description of Artificial Sequence: Synthetic polypeptide
  XENP29440 Chain 1 - human_IL15Ra(sushi)_(GGGGS)5-human_ IL15(N4D/N65D;single-Chain)_Fc(216)_IgG1_pI(-)_ Isosteric_A_C220S/PVA_/S267K/L368D/K370S/M428L/N434S scIL-15/Ralpha-Fc Chain

SEQ ID NO: 176 - protein, 448 aa, Artificial Sequence
  Description of Artificial Sequence: Synthetic polypeptide
  XENP29440 Chain 2 - mAb A[PD-1]_H1L1_IgG1_PVA_/S267K/ S364K/E357Q/M428L/N434S Heavy Chain
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 177 - protein, 214 aa, Artificial Sequence; identical to SEQ ID NO: 157
  Description of Artificial Sequence: Synthetic polypeptide
  XENP29440 Chain 3 - mAb A[PD-1]_L1 Light Chain

SEQ ID NO: 178 - protein, 435 aa, Artificial Sequence; identical to SEQ ID NO: 138
  Description of Artificial Sequence: Synthetic polypeptide
  XENP29441 Chain 1 - human_IL15Ra(sushi)_(GGGGS)5-human_ IL15(N4D/N65D;single-Chain)_Fc(216)_IgG1_pI(-)_ Isosteric_A_C220S/PVA_/S267K/L368D/K370S/M428L/N434S scIL-15/Ralpha-Fc Chain

SEQ ID NO: 179 - protein, 446 aa, Artificial Sequence
  Description of Artificial Sequence: Synthetic polypeptide
  XENP29441 Chain 2 - mAb B[PD-1]_H1_IgG1_PVA_/S267K/ S364K/E357Q/M428L/N434S Heavy Chain
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 180 - protein, 214 aa, Artificial Sequence; identical to SEQ ID NO: 159
  Description of Artificial Sequence: Synthetic polypeptide
  XENP29441 Chain 3 - mAb B[PD-1]_L1 Light Chain

SEQ ID NO: 181 - protein, 435 aa, Artificial Sequence; identical to SEQ ID NO: 136
  Description of Artificial Sequence: Synthetic polypeptide
  XENP26007 Chain 1 - human_IL15Ra(sushi)_(GGGGS)5-human_ IL15(N4D/N65D;single-Chain)_Fc(216)_IgG1_pI(-)_ Isosteric_A_C220S/PVA_/S267K/L368D/K370S scIL-15/Ralpha-Fc Chain

SEQ ID NO: 182 - protein, 449 aa, Artificial Sequence
  Description of Artificial Sequence: Synthetic polypeptide
  XENP26007 Chain 2 - Numax_IgG1_PVA_/S267K/S364K/E357Q Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 213 aa, Artificial Sequence; identical to SEQ ID NO: 145
  Description of Artificial Sequence: Synthetic polypeptide
  XENP26007 Chain 3 - Numax Light Chain

SEQ ID NO: 184 - protein, 435 aa, Artificial Sequence; identical to SEQ ID NO: 142
  Description of Artificial Sequence: Synthetic polypeptide
  XENP30432 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S

SEQ ID NO: 185 - protein, 449 aa, Artificial Sequence; identical to SEQ ID NO: 182
  Description of Artificial Sequence: Synthetic polypeptide
  XENP30432 Chain 2 -  Numax_VH_IgG1_IgG1_PVA_/S267K/ S364K/E357Q

SEQ ID NO: 186 - protein, 213 aa, Artificial Sequence; identical to SEQ ID NO: 145
  Description of Artificial Sequence: Synthetic polypeptide
  XENP30432 Chain 3 -  Numax LC

SEQ ID NO: 187 - protein, 435 aa, Artificial Sequence; identical to SEQ ID NO: 140
  Description of Artificial Sequence: Synthetic polypeptide
  XENP29481 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 188 - protein, 449 aa, Artificial Sequence; identical to SEQ ID NO: 182
  Description of Artificial Sequence: Synthetic polypeptide
  XENP29481 Chain 2 -  Numax_IgG1_PVA_/S267K/S364K/E357Q

SEQ ID NO: 189 - protein, 213 aa, Artificial Sequence; identical to SEQ ID NO: 145
  Description of Artificial Sequence: Synthetic polypeptide
  XENP29481 Chain 3 -  Numax LC

SEQ ID NO: 190 - protein, 435 aa, Artificial Sequence; identical to SEQ ID NO: 140
  Description of Artificial Sequence: Synthetic polypeptide
  XENP29484 Chain 1 - human_IL15Ra(sushi)_(GGGGS)5-human_ IL15(D30N/N65D;single-Chain)_Fc(216)_IgG1_pI(-)_ Isosteric_A_C220S/PVA_/S267K/L368D/K370S scIL-15/Ralpha-Fc Chain

SEQ ID NO: 191 - protein, 448 aa, Artificial Sequence; identical to SEQ ID NO: 167
  Description of Artificial Sequence: Synthetic polypeptide
  XENP29484 Chain 2 - mAb A[PD-1]_H1_IgG1_PVA_/S267K/ S364K/E357Q Heavy Chain

SEQ ID NO: 192 - protein, 214 aa, Artificial Sequence; identical to SEQ ID NO: 157
  Description of Artificial Sequence: Synthetic polypeptide
  XENP29484 Chain 3 - mAb A[PD-1]_L1 Light Chain

SEQ ID NO: 193 - protein, 435 aa, Artificial Sequence; identical to SEQ ID NO: 140
  Description of Artificial Sequence: Synthetic polypeptide
  XENP29485 Chain 1 - human_IL15Ra(sushi)_(GGGGS)5-human_ IL15(D30N/N65D;single-Chain)_Fc(216)_IgG1_pI(-)_ Isosteric_A_C220S/PVA_/S267K/L368D/K370S scIL-15/Ralpha-Fc Chain

SEQ ID NO: 194 - protein, 446 aa, Artificial Sequence; identical to SEQ ID NO: 170
  Description of Artificial Sequence: Synthetic polypeptide
  XENP29485 Chain 2 - mAb B[PD-1]_H1_IgG1_PVA_/S267K/ S364K/E357Q Heavy Chain

SEQ ID NO: 195 - protein, 214 aa, Artificial Sequence; identical to SEQ ID NO: 159
  Description of Artificial Sequence: Synthetic polypeptide
  XENP29485 Chain 3 - mAb B[PD-1]_L1 Light Chain

SEQ ID NO: 196 - protein, 119 aa, Artificial Sequence
  Description of Artificial Sequence: Synthetic polypeptide
  mAb A[PD-1]_H1
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSS

SEQ ID NO: 197 - protein, 107 aa, Artificial Sequence
  Description of Artificial Sequence: Synthetic polypeptide
  mAb A[PD-1]_L1
DIQMTQSPSSLSASVGDRVTITCRASENIHNYLAWYQQKPGKSPKLLVYNVKTLADGVPSRFSGSGSGTDYTLTISSLQPEDFATYYCQHFWSSPWTFGGGTKVEIK

SEQ ID NO: 198 - protein, 117 aa, Artificial Sequence
  Description of Artificial Sequence: Synthetic polypeptide
  mAb B[PD-1]_H1
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSS

SEQ ID NO: 199 - protein, 107 aa, Artificial Sequence
  Description of Artificial Sequence: Synthetic polypeptide
  mAb B[PD-1]_L1
DIQMTQSPSSLSASVGDRVTITCRASQGISGDLNWYQQKPGKTVKLLIYHTSSLHSGVPLRFSGSGSGTDYTLTISSLQPEDFATYYCQYYSKDLLTFGAGTKLEIK

SEQ ID NO: 200 - protein, 119 aa, Artificial Sequence
  Description of Artificial Sequence: Synthetic polypeptide
  mAb C[PD1]_H1.1
EVQLVESGGGLVQPGGSLRLSCAASGFTFTSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 201 - protein, 119 aa, Artificial Sequence
  Description of Artificial Sequence: Synthetic polypeptide
  mAb C[PD1]_H1.2
EVQLVESGGGLVQPGGSLRLSCAASGFTFASFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 202 - protein, 119 aa, Artificial Sequence
  Description of Artificial Sequence: Synthetic polypeptide
  mAb C[PD1]_H1.3
EVQLVESGGGLVQPGGSLRLSCAASGFTFQSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 203 - protein, 119 aa, Artificial Sequence
  Description of Artificial Sequence: Synthetic polypeptide
  mAb C[PD1]_H1.4
EVQLVESGGGLVQPGGSLRLSCAASGFTFGSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 204 - protein, 119 aa, Artificial Sequence
  Description of Artificial Sequence: Synthetic polypeptide
  mAb C[PD1]_H1.5
EVQLVESGGGLVQPGGSLRLSCAASGFTFVSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 205 - protein, 119 aa, Artificial Sequence
  Description of Artificial Sequence: Synthetic polypeptide
  mAb C[PD1]_H1.6
EVQLVESGGGLVQPGGSLRLSCAASGFTFHSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 206 - protein, 119 aa, Artificial Sequence
  Description of Artificial Sequence: Synthetic polypeptide
  mAb C[PD1]_H1.7
EVQLVESGGGLVQPGGSLRLSCAASGFTFKSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 207 - protein, 119 aa, Artificial Sequence
  Description of Artificial Sequence: Synthetic polypeptide
  mAb C[PD1]_H1.8
EVQLVESGGGLVQPGGSLRLSCAASGFTFYSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 208 - protein, 119 aa, Artificial Sequence
  Description of Artificial Sequence: Synthetic polypeptide
  mAb C[PD1]_H1.9
EVQLVESGGGLVQPGGSLRLSCAASGFTFSTFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 209 - protein, 119 aa, Artificial Sequence
  Description of Artificial Sequence: Synthetic polypeptide
  mAb C[PD1]_H1.10
EVQLVESGGGLVQPGGSLRLSCAASGFTFSAFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 210 - protein, 119 aa, Artificial Sequence
  Description of Artificial Sequence: Synthetic polypeptide
  mAb C[PD1]_H1.11
EVQLVESGGGLVQPGGSLRLSCAASGFTFSQFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 211 - protein, 119 aa, Artificial Sequence
  Description of Artificial Sequence: Synthetic polypeptide
  mAb C[PD1]_H1.12
EVQLVESGGGLVQPGGSLRLSCAASGFTFSGFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 212 - protein, 119 aa, Artificial Sequence
  Description of Artificial Sequence: Synthetic polypeptide
  mAb C[PD1]_H1.13
EVQLVESGGGLVQPGGSLRLSCAASGFTFSVFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 213 - protein, 119 aa, Artificial Sequence
  Description of Artificial Sequence: Synthetic polypeptide
  mAb C[PD1]_H1.14
EVQLVESGGGLVQPGGSLRLSCAASGFTFSHFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 214 - protein, 119 aa, Artificial Sequence
  Description of Artificial Sequence: Synthetic polypeptide
  mAb C[PD1]_H1.15
EVQLVESGGGLVQPGGSLRLSCAASGFTFSDFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 215 - protein, 119 aa, Artificial Sequence
  Description of Artificial Sequence: Synthetic polypeptide
  mAb C[PD1]_H1.16
EVQLVESGGGLVQPGGSLRLSCAASGFTFSKFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 216 - protein, 119 aa, Artificial Sequence
  Description of Artificial Sequence: Synthetic polypeptide
  mAb C[PD1]_H1.17
EVQLVESGGGLVQPGGSLRLSCAASGFTFSYFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 217 - protein, 119 aa, Artificial Sequence
  Description of Artificial Sequence: Synthetic polypeptide
  mAb C[PD1]_H1.18
EVQLVESGGGLVQPGGSLRLSCAASGFTFSSYGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 218 - protein, 119 aa, Artificial Sequence
  Description of Artificial Sequence: Synthetic polypeptide
  mAb C[PD1]_H1.19
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 219 - protein, 119 aa, Artificial Sequence
  Description of Artificial Sequence: Synthetic polypeptide
  mAb C[PD1]_H1.20
EVQLVESGGGLVQPGGSLRLSCAASGFTFSSWGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 220 - protein, 119 aa, Artificial Sequence
  Description of Artificial Sequence: Synthetic polypeptide
  mAb C[PD1]_H1.21
EVQLVESGGGLVQPGGSLRLSCAASGFTFSSIGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 221 - protein, 119 aa, Artificial Sequence
  Description of Artificial Sequence: Synthetic polypeptide
  mAb C[PD1]_H1.22
EVQLVESGGGLVQPGGSLRLSCAASGFTFSSHGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 222 - protein, 119 aa, Artificial Sequence
  Description of Artificial Sequence: Synthetic polypeptide
  mAb C[PD1]_H1.23
EVQLVESGGGLVQPGGSLRLSCAASGFTFSSQGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 223 - protein, 119 aa, Artificial Sequence
  Description of Artificial Sequence: Synthetic polypeptide
  mAb C[PD1]_H1.24
EVQLVESGGGLVQPGGSLRLSCAASGFTFSSSGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 224 - protein, 119 aa, Artificial Sequence
  Description of Artificial Sequence: Synthetic polypeptide
  mAb C[PD1]_H1.25
EVQLVESGGGLVQPGGSLRLSCAASGFTFSSKGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 225 - protein, 119 aa, Artificial Sequence
  Description of Artificial Sequence: Synthetic polypeptide
  mAb C[PD1]_H1.26
EVQLVESGGGLVQPGGSLRLSCAASGFTFSSFAMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 226 - protein, 119 aa, Artificial Sequence
  Description of Artificial Sequence: Synthetic polypeptide
  mAb C[PD1]_H1.27
EVQLVESGGGLVQPGGSLRLSCAASGFTFSSFSMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 227 - protein, 119 aa, Artificial Sequence
  Description of Artificial Sequence: Synthetic polypeptide
  mAb C[PD1]_H1.28
EVQLVESGGGLVQPGGSLRLSCAASGFTFSSFTMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 228 - protein, 119 aa, Artificial Sequence
  Description of Artificial Sequence: Synthetic polypeptide
  mAb C[PD1]_H1.29
EVQLVESGGGLVQPGGSLRLSCAASGFTFSSFNMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 229 - protein, 119 aa, Artificial Sequence
  Description of Artificial Sequence: Synthetic polypeptide
  mAb C[PD1]_H1.30
EVQLVESGGGLVQPGGSLRLSCAASGFTFSSFHMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 230 - protein, 119 aa, Artificial Sequence
  Description of Artificial Sequence: Synthetic polypeptide
  mAb C[PD1]_H1.31
EVQLVESGGGLVQPGGSLRLSCAASGFTFSSFDMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 231 - protein, 119 aa, Artificial Sequence
  Description of Artificial Sequence: Synthetic polypeptide
  mAb C[PD1]_H1.32
EVQLVESGGGLVQPGGSLRLSCAASGFTFSSFKMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 232 - protein, 119 aa, Artificial Sequence
  Description of Artificial Sequence: Synthetic polypeptide
  mAb C[PD1]_H1.33
EVQLVESGGGLVQPGGSLRLSCAASGFTFSSFLMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 233 - protein, 119 aa, Artificial Sequence
  Description of Artificial Sequence: Synthetic polypeptide
  mAb C[PD1]_H1.34
EVQLVESGGGLVQPGGSLRLSCAASGFTFSSFYMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 234 - protein, 119 aa, Artificial Sequence
  Description of Artificial Sequence: Synthetic polypeptide
  mAb C[PD1]_H1.35
EVQLVESGGGLVQPGGSLRLSCAASGFTFSSFGMNWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 235 - protein, 119 aa, Artificial Sequence
  Description of Artificial Sequence: Synthetic polypeptide
  mAb C[PD1]_H1.36
EVQLVESGGGLVQPGGSLRLSCAASGFTFSSFGMHWVRQAPGKGLEWVSYITSGSSIIYYADSVKGRFTISRDNAKNSLYLQMNSLRAEDTAVYYCARGGRLVWSPDYWGQGTLVTVSS

SEQ ID NO: 236 - protein, 119 aa, Artificial Sequence
  Description of Artificial Sequence: Synthetic polypeptide
  mAb C[PD1]_H1.37
EVQLVESGGGLVQPGGSLRLSCAASGFTFSSFGMHWVRQAPGKGLEWVSYIASGSSIIYYADSVKGRFTISRDNAKNSLYLQMNSLRAEDTAVYYCARGGRLVWSPDYWGQGTLVTVSS

SEQ ID NO: 237 - protein, 119 aa, Artificial Sequence
  Description of Artificial Sequence: Synthetic polypeptide
  mAb C[PD1]_H1.38
EVQLVESGGGLVQPGGSLRLSCAASGFTFSSFGMHWVRQAPGKGLEWVSYIQSGSSIIYYADSVKGRFTISRDNAKNSLYLQMNSLRAEDTAVYYCARGGRLVWSPDYWGQGTLVTVSS

SEQ ID NO: 238 - protein, 119 aa, Artificial Sequence
  Description of Artificial Sequence: Synthetic polypeptide
  mAb C[PD1]_H1.39
EVQLVESGGGLVQPGGSLRLSCAASGFTFSSFGMHWVRQAPGKGLEWVSYIGSGSSIIYYADSVKGRFTISRDNAKNSLYLQMNSLRAEDTAVYYCARGGRLVWSPDYWGQGTLVTVSS

SEQ ID NO: 239 - protein, 119 aa, Artificial Sequence
  Description of Artificial Sequence: Synthetic polypeptide
  mAb C[PD1]_H1.40
EVQLVESGGGLVQPGGSLRLSCAASGFTFSSFGMHWVRQAPGKGLEWVSYIVSGSSIIYYADSVKGRFTISRDNAKNSLYLQMNSLRAEDTAVYYCARGGRLVWSPDYWGQGTLVTVSS

SEQ ID NO: 240 - protein, 119 aa, Artificial Sequence
  Description of Artificial Sequence: Synthetic polypeptide
  mAb C[PD1]_H1.41
EVQLVESGGGLVQPGGSLRLSCAASGFTFSSFGMHWVRQAPGKGLEWVSYIHSGSSIIYYADSVKGRFTISRDNAKNSLYLQMNSLRAEDTAVYYCARGGRLVWSPDYWGQGTLVTVSS

SEQ ID NO: 241 - protein, 119 aa, Artificial Sequence
  Description of Artificial Sequence: Synthetic polypeptide
  mAb C[PD1]_H1.42
EVQLVESGGGLVQPGGSLRLSCAASGFTFSSFGMHWVRQAPGKGLEWVSYIKSGSSIIYYADSVKGRFTISRDNAKNSLYLQMNSLRAEDTAVYYCARGGRLVWSPDYWGQGTLVTVSS

SEQ ID NO: 242 - protein, 119 aa, Artificial Sequence
  Description of Artificial Sequence: Synthetic polypeptide
  mAb C[PD1]_H1.43
EVQLVESGGGLVQPGGSLRLSCAASGFTFSSFGMHWVRQAPGKGLEWVSYIYSGSSIIYYADSVKGRFTISRDNAKNSLYLQMNSLRAEDTAVYYCARGGRLVWSPDYWGQGTLVTVSS

SEQ ID NO: 243 - protein, 119 aa, Artificial Sequence
  Description of Artificial Sequence: Synthetic polypeptide
  mAb C[PD1]_H1.44
EVQLVESGGGLVQPGGSLRLSCAASGFTFSSFGMHWVRQAPGKGLEWVSYIESGSSIIYYADSVKGRFTISRDNAKNSLYLQMNSLRAEDTAVYYCARGGRLVWSPDYWGQGTLVTVSS

SEQ ID NO: 244 - protein, 119 aa, Artificial Sequence
  Description of Artificial Sequence: Synthetic polypeptide
  mAb C[PD1]_H1.45
EVQLVESGGGLVQPGGSLRLSCAASGFTFSSFGMHWVRQAPGKGLEWVSYISTGSSIIYYADSVKGRFTISRDNAKNSLYLQMNSLRAEDTAVYYCARGGRLVWSPDYWGQGTLVTVSS

SEQ ID NO: 245 - protein, 119 aa, Artificial Sequence
  Description of Artificial Sequence: Synthetic polypeptide
  mAb C[PD1]_H1.46
EVQLVESGGGLVQPGGSLRLSCAASGFTFSSFGMHWVRQAPGKGLEWVSYISAGSSIIYYADSVKGRFTISRDNAKNSLYLQMNSLRAEDTAVYYCARGGRLVWSPDYWGQGTLVTVSS

SEQ ID NO: 246 - protein, 119 aa, Artificial Sequence
  Description of Artificial Sequence: Synthetic polypeptide
  mAb C[PD1]_H1.47
EVQLVESGGGLVQPGGSLRLSCAASGFTFSSFGMHWVRQAPGKGLEWVSYISQGSSIIYYADSVKGRFTISRDNAKNSLYLQMNSLRAEDTAVYYCARGGRLVWSPDYWGQGTLVTVSS

SEQ ID NO: 247 - protein, 119 aa, Artificial Sequence
  Description of Artificial Sequence: Synthetic polypeptide
  mAb C[PD1]_H1.48
EVQLVESGGGLVQPGGSLRLSCAASGFTFSSFGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 248 - protein, 119 aa, Artificial Sequence
  Description of Artificial Sequence: Synthetic polypeptide
  mAb C[PD1]_H1.49
EVQLVESGGGLVQPGGSLRLSCAASGFTFSSFGMHWVRQAPGKGLEWVSYISVGSSIIYYADSVKGRFTISRDNAKNSLYLQMNSLRAEDTAVYYCARGGRLVWSPDYWGQGTLVTVSS

SEQ ID NO: 249 - protein, 119 aa, Artificial Sequence
  Description of Artificial Sequence: Synthetic polypeptide
  mAb C[PD1]_H1.50
EVQLVESGGGLVQPGGSLRLSCAASGFTFSSFGMHWVRQAPGKGLEWVSYISHGSSIIYYADSVKGRFTISRDNAKNSLYLQMNSLRAEDTAVYYCARGGRLVWSPDYWGQGTLVTVSS

SEQ ID NO: 250 - protein, 119 aa, Artificial Sequence
  Description of Artificial Sequence: Synthetic polypeptide
  mAb C[PD1]_H1.51
EVQLVESGGGLVQPGGSLRLSCAASGFTFSSFGMHWVRQAPGKGLEWVSYISKGSSIIYYADSVKGRFTISRDNAKNSLYLQMNSLRAEDTAVYYCARGGRLVWSPDYWGQGTLVTVSS

SEQ ID NO: 251 - protein, 119 aa, Artificial Sequence
  Description of Artificial Sequence: Synthetic polypeptide
  mAb C[PD1]_H1.52
EVQLVESGGGLVQPGGSLRLSCAASGFTFSSFGMHWVRQAPGKGLEWVSYISYGSSIIYYADSVKGRFTISRDNAKNSLYLQMNSLRAEDTAVYYCARGGRLVWSPDYWGQGTLVTVSS

SEQ ID NO: 252 - protein, 119 aa, Artificial Sequence
  Description of Artificial Sequence: Synthetic polypeptide
  mAb C[PD1]_H1.53
EVQLVESGGGLVQPGGSLRLSCAASGFTFSSFGMHWVRQAPGKGLEWVSYISEGSSIIYYADSVKGRFTISRDNAKNSLYLQMNSLRAEDTAVYYCARGGRLVWSPDYWGQGTLVTVSS

SEQ ID NO: 253 - protein, 119 aa, Artificial Sequence
  Description of Artificial Sequence: Synthetic polypeptide
  mAb C[PD1]_H1.54
EVQLVESGGGLVQPGGSLRLSCAASGFTFSSFGMHWVRQAPGKGLEWVSYISSASSIIYYADSVKGRFTISRDNAKNSLYLQMNSLRAEDTAVYYCARGGRLVWSPDYWGQGTLVTVSS

SEQ ID NO: 254 - protein, 119 aa, Artificial Sequence
  Description of Artificial Sequence: Synthetic polypeptide
  mAb C[PD1]_H1.55
EVQLVESGGGLVQPGGSLRLSCAASGFTFSSFGMHWVRQAPGKGLEWVSYISSSSSIIYYADSVKGRFTISRDNAKNSLYLQMNSLRAEDTAVYYCARGGRLVWSPDYWGQGTLVTVSS

SEQ ID NO: 255 - protein, 119 aa, Artificial Sequence
  Description of Artificial Sequence: Synthetic polypeptide
  mAb C[PD1]_H1.56
EVQLVESGGGLVQPGGSLRLSCAASGFTFSSFGMHWVRQAPGKGLEWVSYISSTSSIIYYADSVKGRFTISRDNAKNSLYLQMNSLRAEDTAVYYCARGGRLVWSPDYWGQGTLVTVSS

SEQ ID NO: 256 - protein, 119 aa, Artificial Sequence
  Description of Artificial Sequence: Synthetic polypeptide
  mAb C[PD1]_H1.57
EVQLVESGGGLVQPGGSLRLSCAASGFTFSSFGMHWVRQAPGKGLEWVSYISSQSSIIYYADSVKGRFTISRDNAKNSLYLQMNSLRAEDTAVYYCARGGRLVWSPDYWGQGTLVTVSS

SEQ ID NO: 257 - protein, 119 aa, Artificial Sequence
  Description of Artificial Sequence: Synthetic polypeptide
  mAb C[PD1]_H1.58
EVQLVESGGGLVQPGGSLRLSCAASGFTFSSFGMHWVRQAPGKGLEWVSYISSHSSIIYYADSVKGRFTISRDNAKNSLYLQMNSLRAEDTAVYYCARGGRLVWSPDYWGQGTLVTVSS

SEQ ID NO: 258 - protein, 119 aa, Artificial Sequence
  Description of Artificial Sequence: Synthetic polypeptide
  mAb C[PD1]_H1.59
EVQLVESGGGLVQPGGSLRLSCAASGFTFSSFGMHWVRQAPGKGLEWVSYISSKSSIIYYADSVKGRFTISRDNAKNSLYLQMNSLRAEDTAVYYCARGGRLVWSPDYWGQGTLVTVSS

SEQ ID NO: 259 - protein, 119 aa, Artificial Sequence
  Description of Artificial Sequence: Synthetic polypeptide
  mAb C[PD1]_H1.60
EVQLVESGGGLVQPGGSLRLSCAASGFTFSSFGMHWVRQAPGKGLEWVSYISSLSSIIYYADSVKGRFTISRDNAKNSLYLQMNSLRAEDTAVYYCARGGRLVWSPDYWGQGTLVTVSS

SEQ ID NO: 260 - protein, 119 aa, Artificial Sequence
  Description of Artificial Sequence: Synthetic polypeptide
  mAb C[PD1]_H1.61
EVQLVESGGGLVQPGGSLRLSCAASGFTFSSFGMHWVRQAPGKGLEWVSYISSYSSIIYYADSVKGRFTISRDNAKNSLYLQMNSLRAEDTAVYYCARGGRLVWSPDYWGQGTLVTVSS

SEQ ID NO: 261 - protein, 119 aa, Artificial Sequence
  Description of Artificial Sequence: Synthetic polypeptide
  mAb C[PD1]_H1.62
EVQLVESGGGLVQPGGSLRLSCAASGFTFSSFGMHWVRQAPGKGLEWVSYISSGTSIIYYADSVKGRFTISRDNAKNSLYLQMNSLRAEDTAVYYCARGGRLVWSPDYWGQGTLVTVSS

SEQ ID NO: 262 - protein, 119 aa, Artificial Sequence
  Description of Artificial Sequence: Synthetic polypeptide
  mAb C[PD1]_H1.63
EVQLVESGGGLVQPGGSLRLSCAASGFTFSSFGMHWVRQAPGKGLEWVSYISSGASIIYYADSVKGRFTISRDNAKNSLYLQMNSLRAEDTAVYYCARGGRLVWSPDYWGQGTLVTVSS

SEQ ID NO: 263 - protein, 119 aa, Artificial Sequence
  Description of Artificial Sequence: Synthetic polypeptide
  mAb C[PD1]_H1.64
EVQLVESGGGLVQPGGSLRLSCAASGFTFSSFGMHWVRQAPGKGLEWVSYISSGQSIIYYADSVKGRFTISRDNAKNSLYLQMNSLRAEDTAVYYCARGGRLVWSPDYWGQGTLVTVSS

SEQ ID NO: 264 - protein, 119 aa, Artificial Sequence
  Description of Artificial Sequence: Synthetic polypeptide
  mAb C[PD1]_H1.65
EVQLVESGGGLVQPGGSLRLSCAASGFTFSSFGMHWVRQAPGKGLEWVSYISSGGSIIYYADSVKGRFTISRDNAKNSLYLQMNSLRAEDTAVYYCARGGRLVWSPDYWGQGTLVTVSS

SEQ ID NO: 265 - protein, 119 aa, Artificial Sequence
  Description of Artificial Sequence: Synthetic polypeptide
  mAb C[PD1]_H1.66
EVQLVESGGGLVQPGGSLRLSCAASGFTFSSFGMHWVRQAPGKGLEWVSYISSGVSIIYYADSVKGRFTISRDNAKNSLYLQMNSLRAEDTAVYYCARGGRLVWSPDYWGQGTLVTVSS

SEQ ID NO: 266 - protein, 119 aa, Artificial Sequence
  Description of Artificial Sequence: Synthetic polypeptide
  mAb C[PD1]_H1.67
EVQLVESGGGLVQPGGSLRLSCAASGFTFSSFGMHWVRQAPGKGLEWVSYISSGHSIIYYADSVKGRFTISRDNAKNSLYLQMNSLRAEDTAVYYCARGGRLVWSPDYWGQGTLVTVSS

SEQ ID NO: 267 - protein, 119 aa, Artificial Sequence
  Description of Artificial Sequence: Synthetic polypeptide
  mAb C[PD1]_H1.68
EVQLVESGGGLVQPGGSLRLSCAASGFTFSSFGMHWVRQAPGKGLEWVSYISSGKSIIYYADSVKGRFTISRDNAKNSLYLQMNSLRAEDTAVYYCARGGRLVWSPDYWGQGTLVTVSS

SEQ ID NO: 268 - protein, 119 aa, Artificial Sequence
  Description of Artificial Sequence: Synthetic polypeptide
  mAb C[PD1]_H1.69
EVQLVESGGGLVQPGGSLRLSCAASGFTFSSFGMHWVRQAPGKGLEWVSYISSGYSIIYYADSVKGRFTISRDNAKNSLYLQMNSLRAEDTAVYYCARGGRLVWSPDYWGQGTLVTVSS

SEQ ID NO: 269 - protein, 119 aa, Artificial Sequence
  Description of Artificial Sequence: Synthetic polypeptide
  mAb C[PD1]_H1.70
EVQLVESGGGLVQPGGSLRLSCAASGFTFSSFGMHWVRQAPGKGLEWVSYISSGESIIYYADSVKGRFTISRDNAKNSLYLQMNSLRAEDTAVYYCARGGRLVWSPDYWGQGTLVTVSS

SEQ ID NO: 270 - protein, 119 aa, Artificial Sequence
  Description of Artificial Sequence: Synthetic polypeptide
  mAb C[PD1]_H1.71
EVQLVESGGGLVQPGGSLRLSCAASGFTFSSFGMHWVRQAPGKGLEWVSYISSGSTIIYYADSVKGRFTISRDNAKNSLYLQMNSLRAEDTAVYYCARGGRLVWSPDYWGQGTLVTVSS

SEQ ID NO: 271 - protein, 119 aa, Artificial Sequence
  Description of Artificial Sequence: Synthetic polypeptide
  mAb C[PD1]_H1.72
EVQLVESGGGLVQPGGSLRLSCAASGFTFSSFGMHWVRQAPGKGLEWVSYISSGSAIIYYADSVKGRFTISRDNAKNSLYLQMNSLRAEDTAVYYCARGGRLVWSPDYWGQGTLVTVSS

SEQ ID NO: 272 - protein, 119 aa, Artificial Sequence
  Description of Artificial Sequence: Synthetic polypeptide
  mAb C[PD1]_H1.73
EVQLVESGGGLVQPGGSLRLSCAASGFTFSSFGMHWVRQAPGKGLEWVSYISSGSQIIYYADSVKGRFTISRDNAKNSLYLQMNSLRAEDTAVYYCARGGRLVWSPDYWGQGTLVTVSS

SEQ ID NO: 273 - protein, 119 aa, Artificial Sequence
  Description of Artificial Sequence: Synthetic polypeptide
  mAb C[PD1]_H1.74
EVQLVESGGGLVQPGGSLRLSCAASGFTFSSFGMHWVRQAPGKGLEWVSYISSGSGIIYYADSVKGRFTISRDNAKNSLYLQMNSLRAEDTAVYYCARGGRLVWSPDYWGQGTLVTVSS

SEQ ID NO: 274 - protein, 119 aa, Artificial Sequence
  Description of Artificial Sequence: Synthetic polypeptide
  mAb C[PD1]_H1.75
EVQLVESGGGLVQPGGSLRLSCAASGFTFSSFGMHWVRQAPGKGLEWVSYISSGSVIIYYADSVKGRFTISRDNAKNSLYLQMNSLRAEDTAVYYCARGGRLVWSPDYWGQGTLVTVSS

SEQ ID NO: 275 - protein, 119 aa, Artificial Sequence
  Description of Artificial Sequence: Synthetic polypeptide
  mAb C[PD1]_H1.76
EVQLVESGGGLVQPGGSLRLSCAASGFTFSSFGMHWVRQAPGKGLEWVSYISSGSHIIYYADSVKGRFTISRDNAKNSLYLQMNSLRAEDTAVYYCARGGRLVWSPDYWGQGTLVTVSS

SEQ ID NO: 276 - protein, 119 aa, Artificial Sequence
  Description of Artificial Sequence: Synthetic polypeptide
  mAb C[PD1]_H1.77
EVQLVESGGGLVQPGGSLRLSCAASGFTFSSFGMHWVRQAPGKGLEWVSYISSGSDIIYYADSVKGRFTISRDNAKNSLYLQMNSLRAEDTAVYYCARGGRLVWSPDYWGQGTLVTVSS

SEQ ID NO: 277 - protein, 119 aa, Artificial Sequence
  Description of Artificial Sequence: Synthetic polypeptide
  mAb C[PD1]_H1.78
EVQLVESGGGLVQPGGSLRLSCAASGFTFSSFGMHWVRQAPGKGLEWVSYISSGSKIIYYADSVKGRFTISRDNAKNSLYLQMNSLRAEDTAVYYCARGGRLVWSPDYWGQGTLVTVSS

SEQ ID NO: 278 - protein, 119 aa, Artificial Sequence
  Description of Artificial Sequence: Synthetic polypeptide
  mAb C[PD1]_H1.79
EVQLVESGGGLVQPGGSLRLSCAASGFTFSSFGMHWVRQAPGKGLEWVSYISSGSYIIYYADSVKGRFTISRDNAKNSLYLQMNSLRAEDTAVYYCARGGRLVWSPDYWGQGTLVTVSS

SEQ ID NO: 279 - protein, 119 aa, Artificial Sequence
  Description of Artificial Sequence: Synthetic polypeptide
  mAb C[PD1]_H1.80
EVQLVESGGGLVQPGGSLRLSCAASGFTFSSFGMHWVRQAPGKGLEWVSYISSGSSVIYYADSVKGRFTISRDNAKNSLYLQMNSLRAEDTAVYYCARGGRLVWSPDYWGQGTLVTVSS

SEQ ID NO: 280 - protein, 119 aa, Artificial Sequence
  Description of Artificial Sequence: Synthetic polypeptide
  mAb C[PD1]_H1.81
EVQLVESGGGLVQPGGSLRLSCAASGFTFSSFGMHWVRQAPGKGLEWVSYISSGSSLIYYADSVKGRFTISRDNAKNSLYLQMNSLRAEDTAVYYCARGGRLVWSPDYWGQGTLVTVSS

SEQ ID NO: 281 - protein, 119 aa, Artificial Sequence
  Description of Artificial Sequence: Synthetic polypeptide
  mAb C[PD1]_H1.82
EVQLVESGGGLVQPGGSLRLSCAASGFTFSSFGMHWVRQAPGKGLEWVSYISSGSSFIYYADSVKGRFTISRDNAKNSLYLQMNSLRAEDTAVYYCARGGRLVWSPDYWGQGTLVTVSS

SEQ ID NO: 282 - protein, 119 aa, Artificial Sequence
  Description of Artificial Sequence: Synthetic polypeptide
  mAb C[PD1]_H1.83
EVQLVESGGGLVQPGGSLRLSCAASGFTFSSFGMHWVRQAPGKGLEWVSYISSGSSTIYYADSVKGRFTISRDNAKNSLYLQMNSLRAEDTAVYYCARGGRLVWSPDYWGQGTLVTVSS

SEQ ID NO: 283 - protein, 119 aa, Artificial Sequence
  Description of Artificial Sequence: Synthetic polypeptide
  mAb C[PD1]_H1.84
EVQLVESGGGLVQPGGSLRLSCAASGFTFSSFGMHWVRQAPGKGLEWVSYISSGSSWIYYADSVKGRFTISRDNAKNSLYLQMNSLRAEDTAVYYCARGGRLVWSPDYWGQGTLVTVSS

SEQ ID NO: 284 - protein, 119 aa, Artificial Sequence
  Description of Artificial Sequence: Synthetic polypeptide
  mAb C[PD1]_H1.85
EVQLVESGGGLVQPGGSLRLSCAASGFTFSSFGMHWVRQAPGKGLEWVSYISSGSSAIYYADSVKGRFTISRDNAKNSLYLQMNSLRAEDTAVYYCARGGRLVWSPDYWGQGTLVTVSS

SEQ ID NO: 285 - protein, 119 aa, Artificial Sequence
  Description of Artificial Sequence: Synthetic polypeptide
  mAb C[PD1]_H1.86
EVQLVESGGGLVQPGGSLRLSCAASGFTFSSFGMHWVRQAPGKGLEWVSYISSGSSNIYYADSVKGRFTISRDNAKNSLYLQMNSLRAEDTAVYYCARGGRLVWSPDYWGQGTLVTVSS

SEQ ID NO: 286 - protein, 119 aa, Artificial Sequence
  Description of Artificial Sequence: Synthetic polypeptide
  mAb C[PD1]_H1.87
EVQLVESGGGLVQPGGSLRLSCAASGFTFSSFGMHWVRQAPGKGLEWVSYISSGSSEIYYADSVKGRFTISRDNAKNSLYLQMNSLRAEDTAVYYCARGGRLVWSPDYWGQGTLVTVSS

SEQ ID NO: 287 - protein, 119 aa, Artificial Sequence
  Description of Artificial Sequence: Synthetic polypeptide
  mAb C[PD1]_H1.88
EVQLVESGGGLVQPGGSLRLSCAASGFTFSSFGMHWVRQAPGKGLEWVSYISSGSSKIYYADSVKGRFTISRDNAKNSLYLQMNSLRAEDTAVYYCARGGRLVWSPDYWGQGTLVTVSS

SEQ ID NO: 288 - protein, 119 aa, Artificial Sequence
  Description of Artificial Sequence: Synthetic polypeptide
  mAb C[PD1]_H1.89
EVQLVESGGGLVQPGGSLRLSCAASGFTFSSFGMHWVRQAPGKGLEWVSYISSGSSIVYYADSVKGRFTISRDNAKNSLYLQMNSLRAEDTAVYYCARGGRLVWSPDYWGQGTLVTVSS

SEQ ID NO: 289 - protein, 119 aa, Artificial Sequence
  Description of Artificial Sequence: Synthetic polypeptide
  mAb C[PD1]_H1.90
EVQLVESGGGLVQPGGSLRLSCAASGFTFSSFGMHWVRQAPGKGLEWVSYISSGSSILYYADSVKGRFTISRDNAKNSLYLQMNSLRAEDTAVYYCARGGRLVWSPDYWGQGTLVTVSS

SEQ ID NO: 290 - protein, 119 aa, Artificial Sequence
  Description of Artificial Sequence: Synthetic polypeptide
  mAb C[PD1]_H1.91
EVQLVESGGGLVQPGGSLRLSCAASGFTFSSFGMHWVRQAPGKGLEWVSYISSGSSIFYYADSVKGRFTISRDNAKNSLYLQMNSLRAEDTAVYYCARGGRLVWSPDYWGQGTLVTVSS

SEQ ID NO: 291 - protein, 119 aa, Artificial Sequence
  Description of Artificial Sequence: Synthetic polypeptide
  mAb C[PD1]_H1.92
EVQLVESGGGLVQPGGSLRLSCAASGFTFSSFGMHWVRQAPGKGLEWVSYISSGSSITYYADSVKGRFTISRDNAKNSLYLQMNSLRAEDTAVYYCARGGRLVWSPDYWGQGTLVTVSS

SEQ ID NO: 292 - protein, 119 aa, Artificial Sequence
  Description of Artificial Sequence: Synthetic polypeptide
  mAb C[PD1]_H1.93
EVQLVESGGGLVQPGGSLRLSCAASGFTFSSFGMHWVRQAPGKGLEWVSYISSGSSIWYYADSVKGRFTISRDNAKNSLYLQMNSLRAEDTAVYYCARGGRLVWSPDYWGQGTLVTVSS

SEQ ID NO: 293 - protein, 119 aa, Artificial Sequence
  Description of Artificial Sequence: Synthetic polypeptide
  mAb C[PD1]_H1.94
EVQLVESGGGLVQPGGSLRLSCAASGFTFSSFGMHWVRQAPGKGLEWVSYISSGSSIAYYADSVKGRFTISRDNAKNSLYLQMNSLRAEDTAVYYCARGGRLVWSPDYWGQGTLVTVSS

SEQ ID NO: 294 - protein, 119 aa, Artificial Sequence
  Description of Artificial Sequence: Synthetic polypeptide
  mAb C[PD1]_H1.95
EVQLVESGGGLVQPGGSLRLSCAASGFTFSSFGMHWVRQAPGKGLEWVSYISSGSSINYYADSVKGRFTISRDNAKNSLYLQMNSLRAEDTAVYYCARGGRLVWSPDYWGQGTLVTVSS

SEQ ID NO: 295 - protein, 119 aa, Artificial Sequence
  Description of Artificial Sequence: Synthetic polypeptide
  mAb C[PD1]_H1.96
EVQLVESGGGLVQPGGSLRLSCAASGFTFSSFGMHWVRQAPGKGLEWVSYISSGSSIEYYADSVKGRFTISRDNAKNSLYLQMNSLRAEDTAVYYCARGGRLVWSPDYWGQGTLVTVSS

SEQ ID NO: 296 - protein, 119 aa, Artificial Sequence
  Description of Artificial Sequence: Synthetic polypeptide
  mAb C[PD1]_H1.97
EVQLVESGGGLVQPGGSLRLSCAASGFTFSSFGMHWVRQAPGKGLEWVSYISSGSSIKYYADSVKGRFTISRDNAKNSLYLQMNSLRAEDTAVYYCARGGRLVWSPDYWGQGTLVTVSS

SEQ ID NO: 297 - protein, 119 aa, Artificial Sequence
  Description of Artificial Sequence: Synthetic polypeptide
  mAb C[PD1]_H1.98
EVQLVESGGGLVQPGGSLRLSCAASGFTFSSFGMHWVRQAPGKGLEWVSYISSGSSIIFYADSVKGRFTISRDNAKNSLYLQMNSLRAEDTAVYYCARGGRLVWSPDYWGQGTLVTVSS

SEQ ID NO: 298 - protein, 119 aa, Artificial Sequence
  Description of Artificial Sequence: Synthetic polypeptide
  mAb C[PD1]_H1.99
EVQLVESGGGLVQPGGSLRLSCAASGFTFSSFGMHWVRQAPGKGLEWVSYISSGSSIIHYADSVKGRFTISRDNAKNSLYLQMNSLRAEDTAVYYCARGGRLVWSPDYWGQGTLVTVSS

SEQ ID NO: 299 - protein, 119 aa, Artificial Sequence
  Description of Artificial Sequence: Synthetic polypeptide
  mAb C[PD1]_H1.100
EVQLVESGGGLVQPGGSLRLSCAASGFTFSSFGMHWVRQAPGKGLEWVSYISSGSSIILYADSVKGRFTISRDNAKNSLYLQMNSLRAEDTAVYYCARGGRLVWSPDYWGQGTLVTVSS

SEQ ID NO: 300 - protein, 119 aa, Artificial Sequence
  Description of Artificial Sequence: Synthetic polypeptide
  mAb C[PD1]_H1.101
EVQLVESGGGLVQPGGSLRLSCAASGFTFSSFGMHWVRQAPGKGLEWVSYISSGSSIIWYADSVKGRFTISRDNAKNSLYLQMNSLRAEDTAVYYCARGGRLVWSPDYWGQGTLVTVSS

SEQ ID NO: 301 - protein, 119 aa, Artificial Sequence
  Description of Artificial Sequence: Synthetic polypeptide
  mAb C[PD1]_H1.102
EVQLVESGGGLVQPGGSLRLSCAASGFTFSSFGMHWVRQAPGKGLEWVSYISSGSSIIVYADSVKGRFTISRDNAKNSLYLQMNSLRAEDTAVYYCARGGRLVWSPDYWGQGTLVTVSS

SEQ ID NO: 302 - protein, 119 aa, Artificial Sequence
  Description of Artificial Sequence: Synthetic polypeptide
  mAb C[PD1]_H1.103
EVQLVESGGGLVQPGGSLRLSCAASGFTFSSFGMHWVRQAPGKGLEWVSYISSGSSIIAYADSVKGRFTISRDNAKNSLYLQMNSLRAEDTAVYYCARGGRLVWSPDYWGQGTLVTVSS

SEQ ID NO: 303 - protein, 119 aa, Artificial Sequence
  Description of Artificial Sequence: Synthetic polypeptide
  mAb C[PD1]_H1.104
EVQLVESGGGLVQPGGSLRLSCAASGFTFSSFGMHWVRQAPGKGLEWVSYISSGSSIIQYADSVKGRFTISRDNAKNSLYLQMNSLRAEDTAVYYCARGGRLVWSPDYWGQGTLVTVSS

SEQ ID NO: 304 - protein, 119 aa, Artificial Sequence
  Description of Artificial Sequence: Synthetic polypeptide
  mAb C[PD1]_H1.105
EVQLVESGGGLVQPGGSLRLSCAASGFTFSSFGMHWVRQAPGKGLEWVSYISSGSSIIDYADSVKGRFTISRDNAKNSLYLQMNSLRAEDTAVYYCARGGRLVWSPDYWGQGTLVTVSS

SEQ ID NO: 305 - protein, 119 aa, Artificial Sequence
  Description of Artificial Sequence: Synthetic polypeptide
  mAb C[PD1]_H1.106
EVQLVESGGGLVQPGGSLRLSCAASGFTFSSFGMHWVRQAPGKGLEWVSYISSGSSIIKYADSVKGRFTISRDNAKNSLYLQMNSLRAEDTAVYYCARGGRLVWSPDYWGQGTLVTVSS

SEQ ID NO: 306 - protein, 119 aa, Artificial Sequence
  Description of Artificial Sequence: Synthetic polypeptide
  mAb C[PD1]_H1.107
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARAGRLVWSPDYWGQGTLVTVSS

SEQ ID NO: 307 - protein, 119 aa, Artificial Sequence
  Description of Artificial Sequence: Synthetic polypeptide
  mAb C[PD1]_H1.108
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARSGRLVWSPDYWGQGTLVTVSS

SEQ ID NO: 308 - protein, 119 aa, Artificial Sequence
  Description of Artificial Sequence: Synthetic polypeptide
  mAb C[PD1]_H1.109
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARTGRLVWSPDYWGQGTLVTVSS

SEQ ID NO: 309 - protein, 119 aa, Artificial Sequence
  Description of Artificial Sequence: Synthetic polypeptide
  mAb C[PD1]_H1.110
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARQGRLVWSPDYWGQGTLVTVSS

SEQ ID NO: 310 - protein, 119 aa, Artificial Sequence
  Description of Artificial Sequence: Synthetic polypeptide
  mAb C[PD1]_H1.111
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARHGRLVWSPDYWGQGTLVTVSS

SEQ ID NO: 311 - protein, 119 aa, Artificial Sequence
  Description of Artificial Sequence: Synthetic polypeptide
  mAb C[PD1]_H1.112
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARKGRLVWSPDYWGQGTLVTVSS

SEQ ID NO: 312 - protein, 119 aa, Artificial Sequence
  Description of Artificial Sequence: Synthetic polypeptide
  mAb C[PD1]_H1.113
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARLGRLVWSPDYWGQGTLVTVSS

SEQ ID NO: 313 - protein, 119 aa, Artificial Sequence
  Description of Artificial Sequence: Synthetic polypeptide
  mAb C[PD1]_H1.114
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARYGRLVWSPDYWGQGTLVTVSS

SEQ ID NO: 314 - protein, 119 aa, Artificial Sequence
  Description of Artificial Sequence: Synthetic polypeptide
  mAb C[PD1]_H1.115
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGARLVWSPDYWGQGTLVTVSS

SEQ ID NO: 315 - protein, 119 aa, Artificial Sequence
  Description of Artificial Sequence: Synthetic polypeptide
  mAb C[PD1]_H1.116
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGSRLVWSPDYWGQGTLVTVSS

SEQ ID NO: 316 - protein, 119 aa, Artificial Sequence
  Description of Artificial Sequence: Synthetic polypeptide
  mAb C[PD1]_H1.117
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGTRLVWSPDYWGQGTLVTVSS

SEQ ID NO: 317 - protein, 119 aa, Artificial Sequence
  Description of Artificial Sequence: Synthetic polypeptide
  mAb C[PD1]_H1.118
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGQRLVWSPDYWGQGTLVTVSS

SEQ ID NO: 318 - protein, 119 aa, Artificial Sequence
  Description of Artificial Sequence: Synthetic polypeptide
  mAb C[PD1]_H1.119
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGHRLVWSPDYWGQGTLVTVSS

SEQ ID NO: 319 - protein, 119 aa, Artificial Sequence
  Description of Artificial Sequence: Synthetic polypeptide
  mAb C[PD1]_H1.120
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGDRLVWSPDYWGQGTLVTVSS

SEQ ID NO: 320 - protein, 119 aa, Artificial Sequence
  Description of Artificial Sequence: Synthetic polypeptide
  mAb C[PD1]_H1.121
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGKRLVWSPDYWGQGTLVTVSS

SEQ ID NO: 321 - protein, 119 aa, Artificial Sequence
  Description of Artificial Sequence: Synthetic polypeptide
  mAb C[PD1]_H1.122
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGLRLVWSPDYWGQGTLVTVSS

SEQ ID NO: 322 - protein, 119 aa, Artificial Sequence
  Description of Artificial Sequence: Synthetic polypeptide
  mAb C[PD1]_H1.123
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGYRLVWSPDYWGQGTLVTVSS

SEQ ID NO: 323 - protein, 119 aa, Artificial Sequence
  Description of Artificial Sequence: Synthetic polypeptide
  mAb C[PD1]_H1.124
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGKLVWSPDYWGQGTLVTVSS

SEQ ID NO: 324 - protein, 119 aa, Artificial Sequence
  Description of Artificial Sequence: Synthetic polypeptide
  mAb C[PD1]_H1.125
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGELVWSPDYWGQGTLVTVSS

SEQ ID NO: 325 - protein, 119 aa, Artificial Sequence
  Description of Artificial Sequence: Synthetic polypeptide
  mAb C[PD1]_H1.126
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGDLVWSPDYWGQGTLVTVSS

SEQ ID NO: 326 - protein, 119 aa, Artificial Sequence
  Description of Artificial Sequence: Synthetic polypeptide
  mAb C[PD1]_H1.127
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGHLVWSPDYWGQGTLVTVSS

SEQ ID NO: 327 - protein, 119 aa, Artificial Sequence
  Description of Artificial Sequence: Synthetic polypeptide
  mAb C[PD1]_H1.128
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGSLVWSPDYWGQGTLVTVSS

SEQ ID NO: 328 - protein, 119 aa, Artificial Sequence
  Description of Artificial Sequence: Synthetic polypeptide
  mAb C[PD1]_H1.129
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGGLVWSPDYWGQGTLVTVSS

SEQ ID NO: 329 - protein, 119 aa, Artificial Sequence
  Description of Artificial Sequence: Synthetic polypeptide
  mAb C[PD1]_H1.130
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGYLVWSPDYWGQGTLVTVSS

SEQ ID NO: 330 - protein, 119 aa, Artificial Sequence
  Description of Artificial Sequence: Synthetic polypeptide
  mAb C[PD1]_H1.131
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGILVWSPDYWGQGTLVTVSS

SEQ ID NO: 331 - protein, 119 aa, Artificial Sequence
  Description of Artificial Sequence: Synthetic polypeptide
  mAb C[PD1]_H1.132
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGWLVWSPDYWGQGTLVTVSS

SEQ ID NO: 332 - protein, 119 aa, Artificial Sequence
  Description of Artificial Sequence: Synthetic polypeptide
  mAb C[PD1]_H1.133
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRIVWSPDYWGQGTLVTVSS

SEQ ID NO: 333 - protein, 119 aa, Artificial Sequence
  Description of Artificial Sequence: Synthetic polypeptide
  mAb C[PD1]_H1.134
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRFVWSPDYWGQGTLVTVSS

SEQ ID NO: 334 - protein, 119 aa, Artificial Sequence
  Description of Artificial Sequence: Synthetic polypeptide
  mAb C[PD1]_H1.135
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRVVWSPDYWGQGTLVTVSS

SEQ ID NO: 335 - protein, 119 aa, Artificial Sequence
  Description of Artificial Sequence: Synthetic polypeptide
  mAb C[PD1]_H1.136
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRYVWSPDYWGQGTLVTVSS

SEQ ID NO: 336 - protein, 119 aa, Artificial Sequence
  Description of Artificial Sequence: Synthetic polypeptide
  mAb C[PD1]_H1.137
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRWVWSPDYWGQGTLVTVSS

SEQ ID NO: 337 - protein, 119 aa, Artificial Sequence
  Description of Artificial Sequence: Synthetic polypeptide
  mAb C[PD1]_H1.138
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRDVWSPDYWGQGTLVTVSS

SEQ ID NO: 338 - protein, 119 aa, Artificial Sequence
  Description of Artificial Sequence: Synthetic polypeptide
  mAb C[PD1]_H1.139
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRAVWSPDYWGQGTLVTVSS

SEQ ID NO: 339 - protein, 119 aa, Artificial Sequence
  Description of Artificial Sequence: Synthetic polypeptide
  mAb C[PD1]_H1.140
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRQVWSPDYWGQGTLVTVSS

SEQ ID NO: 340 - protein, 119 aa, Artificial Sequence
  Description of Artificial Sequence: Synthetic polypeptide
  mAb C[PD1]_H1.141
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRKVWSPDYWGQGTLVTVSS

SEQ ID NO: 341 - protein, 119 aa, Artificial Sequence
  Description of Artificial Sequence: Synthetic polypeptide
  mAb C[PD1]_H1.142
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLTWSPDYWGQGTLVTVSS

SEQ ID NO: 342 - protein, 119 aa, Artificial Sequence
  Description of Artificial Sequence: Synthetic polypeptide
  mAb C[PD1]_H1.143
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLIWSPDYWGQGTLVTVSS

SEQ ID NO: 343 - protein, 119 aa, Artificial Sequence
  Description of Artificial Sequence: Synthetic polypeptide
  mAb C[PD1]_H1.144
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLLWSPDYWGQGTLVTVSS

SEQ ID NO: 344 - protein, 119 aa, Artificial Sequence
  Description of Artificial Sequence: Synthetic polypeptide
  mAb C[PD1]_H1.145
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLAWSPDYWGQGTLVTVSS

SEQ ID NO: 345 - protein, 119 aa, Artificial Sequence
  Description of Artificial Sequence: Synthetic polypeptide
  mAb C[PD1]_H1.146
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLYWSPDYWGQGTLVTVSS

SEQ ID NO: 346 - protein, 119 aa, Artificial Sequence
  Description of Artificial Sequence: Synthetic polypeptide
  mAb C[PD1]_H1.147
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLQWSPDYWGQGTLVTVSS

SEQ ID NO: 347 - protein, 119 aa, Artificial Sequence
  Description of Artificial Sequence: Synthetic polypeptide
  mAb C[PD1]_H1.148
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLWWSPDYWGQGTLVTVSS

SEQ ID NO: 348 - protein, 119 aa, Artificial Sequence
  Description of Artificial Sequence: Synthetic polypeptide
  mAb C[PD1]_H1.149
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLDWSPDYWGQGTLVTVSS

SEQ ID NO: 349 - protein, 119 aa, Artificial Sequence
  Description of Artificial Sequence: Synthetic polypeptide
  mAb C[PD1]_H1.150
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLKWSPDYWGQGTLVTVSS

SEQ ID NO: 350 - protein, 119 aa, Artificial Sequence
  Description of Artificial Sequence: Synthetic polypeptide
  mAb C[PD1]_H1.151
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVFSPDYWGQGTLVTVSS

SEQ ID NO: 351 - protein, 119 aa, Artificial Sequence
  Description of Artificial Sequence: Synthetic polypeptide
  mAb C[PD1]_H1.152
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVLSPDYWGQGTLVTVSS

SEQ ID NO: 352 - protein, 119 aa, Artificial Sequence
  Description of Artificial Sequence: Synthetic polypeptide
  mAb C[PD1]_H1.153
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVYSPDYWGQGTLVTVSS

SEQ ID NO: 353 - protein, 119 aa, Artificial Sequence
  Description of Artificial Sequence: Synthetic polypeptide
  mAb C[PD1]_H1.154
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVISPDYWGQGTLVTVSS

SEQ ID NO: 354 - protein, 119 aa, Artificial Sequence
  Description of Artificial Sequence: Synthetic polypeptide
  mAb C[PD1]_H1.155
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVHSPDYWGQGTLVTVSS

SEQ ID NO: 355 - protein, 119 aa, Artificial Sequence
  Description of Artificial Sequence: Synthetic polypeptide
  mAb C[PD1]_H1.156
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVQSPDYWGQGTLVTVSS

SEQ ID NO: 356 - protein, 119 aa, Artificial Sequence
  Description of Artificial Sequence: Synthetic polypeptide
  mAb C[PD1]_H1.157
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVSSPDYWGQGTLVTVSS

SEQ ID NO: 357 - protein, 119 aa, Artificial Sequence
  Description of Artificial Sequence: Synthetic polypeptide
  mAb C[PD1]_H1.158
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVESPDYWGQGTLVTVSS

SEQ ID NO: 358 - protein, 119 aa, Artificial Sequence
  Description of Artificial Sequence: Synthetic polypeptide
  mAb C[PD1]_H1.159
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVRSPDYWGQGTLVTVSS

SEQ ID NO: 359 - protein, 119 aa, Artificial Sequence
  Description of Artificial Sequence: Synthetic polypeptide
  mAb C[PD1]_H1.160
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWTPDYWGQGTLVTVSS

SEQ ID NO: 360 - protein, 119 aa, Artificial Sequence
  Description of Artificial Sequence: Synthetic polypeptide
  mAb C[PD1]_H1.161
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWAPDYWGQGTLVTVSS

SEQ ID NO: 361 - protein, 119 aa, Artificial Sequence
  Description of Artificial Sequence: Synthetic polypeptide
  mAb C[PD1]_H1.162
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWQPDYWGQGTLVTVSS

SEQ ID NO: 362 - protein, 119 aa, Artificial Sequence
  Description of Artificial Sequence: Synthetic polypeptide
  mAb C[PD1]_H1.163
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWGPDYWGQGTLVTVSS

SEQ ID NO: 363 - protein, 119 aa, Artificial Sequence
  Description of Artificial Sequence: Synthetic polypeptide
  mAb C[PD1]_H1.164
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWVPDYWGQGTLVTVSS

SEQ ID NO: 364 - protein, 119 aa, Artificial Sequence
  Description of Artificial Sequence: Synthetic polypeptide
  mAb C[PD1]_H1.165
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWHPDYWGQGTLVTVSS

SEQ ID NO: 365 - protein, 119 aa, Artificial Sequence
  Description of Artificial Sequence: Synthetic polypeptide
  mAb C[PD1]_H1.166
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWDPDYWGQGTLVTVSS

SEQ ID NO: 366 - protein, 119 aa, Artificial Sequence
  Description of Artificial Sequence: Synthetic polypeptide
  mAb C[PD1]_H1.167
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWKPDYWGQGTLVTVSS

SEQ ID NO: 367 - protein, 119 aa, Artificial Sequence
  Description of Artificial Sequence: Synthetic polypeptide
  mAb C[PD1]_H1.168
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWYPDYWGQGTLVTVSS

SEQ ID NO: 368 - protein, 113 aa, Artificial Sequence
  Description of Artificial Sequence: Synthetic polypeptide
  mAb C[PD1]_L1.1
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 369 - protein, 113 aa, Artificial Sequence
  Description of Artificial Sequence: Synthetic polypeptide
  mAb C[PD1]_L1.2
DIVMTQSPDSLAVSLGERATINCKSSQSLLESGNQKNYLTWYQQKPGQPPKLLIYWASTRESGVPDRFTGSGSGTDFTLTISSLQAEDVAVYYCQNDYSYPFTFGSGTKLEIK

SEQ ID NO: 370 - protein, 113 aa, Artificial Sequence
  Description of Artificial Sequence: Synthetic polypeptide
  mAb C[PD1]_L1.3
DIVMTQSPDSLAVSLGERATINCKSSQSLLSSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 371 - protein, 113 aa, Artificial Sequence
  Description of Artificial Sequence: Synthetic polypeptide
  mAb C[PD1]_L1.4
DIVMTQSPDSLAVSLGERATINCKSSQSLLRSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 372 - protein, 113 aa, Artificial Sequence
  Description of Artificial Sequence: Synthetic polypeptide
  mAb C[PD1]_L1.5
DIVMTQSPDSLAVSLGERATINCKSSQSLLLSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 373 - protein, 113 aa, Artificial Sequence
  Description of Artificial Sequence: Synthetic polypeptide
  mAb C[PD1]_L1.6
DIVMTQSPDSLAVSLGERATINCKSSQSLLTSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 374 - protein, 113 aa, Artificial Sequence
  Description of Artificial Sequence: Synthetic polypeptide
  mAb C[PD1]_L1.7
DIVMTQSPDSLAVSLGERATINCKSSQSLLGSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 375 - protein, 113 aa, Artificial Sequence
  Description of Artificial Sequence: Synthetic polypeptide
  mAb C[PD1]_L1.8
DIVMTQSPDSLAVSLGERATINCKSSQSLLYSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 376 - protein, 113 aa, Artificial Sequence
  Description of Artificial Sequence: Synthetic polypeptide
  mAb C[PD1]_L1.9
DIVMTQSPDSLAVSLGERATINCKSSQSLLNTGNQKNYLTWYQQKPGQPPKLLIYWASTRESGVPDRFTGSGSGTDFTLTISSLQAEDVAVYYCQNDYSYPFTFGSGTKLEIK

SEQ ID NO: 377 - protein, 113 aa, Artificial Sequence
  Description of Artificial Sequence: Synthetic polypeptide
  mAb C[PD1]_L1.10
DIVMTQSPDSLAVSLGERATINCKSSQSLLNAGNQKNYLTWYQQKPGQPPKLLIYWASTRESGVPDRFTGSGSGTDFTLTISSLQAEDVAVYYCQNDYSYPFTFGSGTKLEIK

SEQ ID NO: 378 - protein, 113 aa, Artificial Sequence
  Description of Artificial Sequence: Synthetic polypeptide
  mAb C[PD1]_L1.11
DIVMTQSPDSLAVSLGERATINCKSSQSLLNQGNQKNYLTWYQQKPGQPPKLLIYWASTRESGVPDRFTGSGSGTDFTLTISSLQAEDVAVYYCQNDYSYPFTFGSGTKLEIK

SEQ ID NO: 379 - protein, 113 aa, Artificial Sequence
  Description of Artificial Sequence: Synthetic polypeptide
  mAb C[PD1]_L1.12
DIVMTQSPDSLAVSLGERATINCKSSQSLLNVGNQKNYLTWYQQKPGQPPKLLIYWASTRESGVPDRFTGSGSGTDFTLTISSLQAEDVAVYYCQNDYSYPFTFGSGTKLEIK

SEQ ID NO: 380 - protein, 113 aa, Artificial Sequence
  Description of Artificial Sequence: Synthetic polypeptide
  mAb C[PD1]_L1.13
DIVMTQSPDSLAVSLGERATINCKSSQSLLNHGNQKNYLTWYQQKPGQPPKLLIYWASTRESGVPDRFTGSGSGTDFTLTISSLQAEDVAVYYCQNDYSYPFTFGSGTKLEIK

SEQ ID NO: 381 - protein, 113 aa, Artificial Sequence
  Description of Artificial Sequence: Synthetic polypeptide
  mAb C[PD1]_L1.14
DIVMTQSPDSLAVSLGERATINCKSSQSLLNKGNQKNYLTWYQQKPGQPPKLLIYWASTRESGVPDRFTGSGSGTDFTLTISSLQAEDVAVYYCQNDYSYPFTFGSGTKLEIK

SEQ ID NO: 382 - protein, 113 aa, Artificial Sequence
  Description of Artificial Sequence: Synthetic polypeptide
  mAb C[PD1]_L1.15
DIVMTQSPDSLAVSLGERATINCKSSQSLLNYGNQKNYLTWYQQKPGQPPKLLIYWASTRESGVPDRFTGSGSGTDFTLTISSLQAEDVAVYYCQNDYSYPFTFGSGTKLEIK

SEQ ID NO: 383 - protein, 113 aa, Artificial Sequence
  Description of Artificial Sequence: Synthetic polypeptide
  mAb C[PD1]_L1.16
DIVMTQSPDSLAVSLGERATINCKSSQSLLNSANQKNYLTWYQQKPGQPPKLLIYWASTRESGVPDRFTGSGSGTDFTLTISSLQAEDVAVYYCQNDYSYPFTFGSGTKLEIK

SEQ ID NO: 384 - protein, 113 aa, Artificial Sequence
  Description of Artificial Sequence: Synthetic polypeptide
  mAb C[PD1]_L1.17
DIVMTQSPDSLAVSLGERATINCKSSQSLLNSQNQKNYLTWYQQKPGQPPKLLIYWASTRESGVPDRFTGSGSGTDFTLTISSLQAEDVAVYYCQNDYSYPFTFGSGTKLEIK

SEQ ID NO: 385 - protein, 113 aa, Artificial Sequence
  Description of Artificial Sequence: Synthetic polypeptide
  mAb C[PD1]_L1.18
DIVMTQSPDSLAVSLGERATINCKSSQSLLNSHNQKNYLTWYQQKPGQPPKLLIYWASTRESGVPDRFTGSGSGTDFTLTISSLQAEDVAVYYCQNDYSYPFTFGSGTKLEIK

SEQ ID NO: 386 - protein, 113 aa, Artificial Sequence
  Description of Artificial Sequence: Synthetic polypeptide
  mAb C[PD1]_L1.19
DIVMTQSPDSLAVSLGERATINCKSSQSLLNSDNQKNYLTWYQQKPGQPPKLLIYWASTRESGVPDRFTGSGSGTDFTLTISSLQAEDVAVYYCQNDYSYPFTFGSGTKLEIK

SEQ ID NO: 387 - protein, 113 aa, Artificial Sequence
  Description of Artificial Sequence: Synthetic polypeptide
  mAb C[PD1]_L1.20
DIVMTQSPDSLAVSLGERATINCKSSQSLLNSKNQKNYLTWYQQKPGQPPKLLIYWASTRESGVPDRFTGSGSGTDFTLTISSLQAEDVAVYYCQNDYSYPFTFGSGTKLEIK

SEQ ID NO: 388 - protein, 113 aa, Artificial Sequence
  Description of Artificial Sequence: Synthetic polypeptide
  mAb C[PD1]_L1.21
DIVMTQSPDSLAVSLGERATINCKSSQSLLNSLNQKNYLTWYQQKPGQPPKLLIYWASTRESGVPDRFTGSGSGTDFTLTISSLQAEDVAVYYCQNDYSYPFTFGSGTKLEIK

SEQ ID NO: 389 - protein, 113 aa, Artificial Sequence
  Description of Artificial Sequence: Synthetic polypeptide
  mAb C[PD1]_L1.22
DIVMTQSPDSLAVSLGERATINCKSSQSLLNSYNQKNYLTWYQQKPGQPPKLLIYWASTRESGVPDRFTGSGSGTDFTLTISSLQAEDVAVYYCQNDYSYPFTFGSGTKLEIK

SEQ ID NO: 390 - protein, 113 aa, Artificial Sequence
  Description of Artificial Sequence: Synthetic polypeptide
  mAb C[PD1]_L1.23
DIVMTQSPDSLAVSLGERATINCKSSQSLLNSGDQKNYLTWYQQKPGQPPKLLIYWASTRESGVPDRFTGSGSGTDFTLTISSLQAEDVAVYYCQNDYSYPFTFGSGTKLEIK

SEQ ID NO: 391 - protein, 113 aa, Artificial Sequence
  Description of Artificial Sequence: Synthetic polypeptide
  mAb C[PD1]_L1.24
DIVMTQSPDSLAVSLGERATINCKSSQSLLNSGHQKNYLTWYQQKPGQPPKLLIYWASTRESGVPDRFTGSGSGTDFTLTISSLQAEDVAVYYCQNDYSYPFTFGSGTKLEIK

SEQ ID NO: 392 - protein, 113 aa, Artificial Sequence
  Description of Artificial Sequence: Synthetic polypeptide
  mAb C[PD1]_L1.25
DIVMTQSPDSLAVSLGERATINCKSSQSLLNSGEQKNYLTWYQQKPGQPPKLLIYWASTRESGVPDRFTGSGSGTDFTLTISSLQAEDVAVYYCQNDYSYPFTFGSGTKLEIK

SEQ ID NO: 393 - protein, 113 aa, Artificial Sequence
  Description of Artificial Sequence: Synthetic polypeptide
  mAb C[PD1]_L1.26
DIVMTQSPDSLAVSLGERATINCKSSQSLLNSGSQKNYLTWYQQKPGQPPKLLIYWASTRESGVPDRFTGSGSGTDFTLTISSLQAEDVAVYYCQNDYSYPFTFGSGTKLEIK

SEQ ID NO: 394 - protein, 113 aa, Artificial Sequence
  Description of Artificial Sequence: Synthetic polypeptide
  mAb C[PD1]_L1.27
DIVMTQSPDSLAVSLGERATINCKSSQSLLNSGRQKNYLTWYQQKPGQPPKLLIYWASTRESGVPDRFTGSGSGTDFTLTISSLQAEDVAVYYCQNDYSYPFTFGSGTKLEIK

SEQ ID NO: 395 - protein, 113 aa, Artificial Sequence
  Description of Artificial Sequence: Synthetic polypeptide
  mAb C[PD1]_L1.28
DIVMTQSPDSLAVSLGERATINCKSSQSLLNSGLQKNYLTWYQQKPGQPPKLLIYWASTRESGVPDRFTGSGSGTDFTLTISSLQAEDVAVYYCQNDYSYPFTFGSGTKLEIK

SEQ ID NO: 396 - protein, 113 aa, Artificial Sequence
  Description of Artificial Sequence: Synthetic polypeptide
  mAb C[PD1]_L1.29
DIVMTQSPDSLAVSLGERATINCKSSQSLLNSGTQKNYLTWYQQKPGQPPKLLIYWASTRESGVPDRFTGSGSGTDFTLTISSLQAEDVAVYYCQNDYSYPFTFGSGTKLEIK

SEQ ID NO: 397 - protein, 113 aa, Artificial Sequence
  Description of Artificial Sequence: Synthetic polypeptide
  mAb C[PD1]_L1.30
DIVMTQSPDSLAVSLGERATINCKSSQSLLNSGGQKNYLTWYQQKPGQPPKLLIYWASTRESGVPDRFTGSGSGTDFTLTISSLQAEDVAVYYCQNDYSYPFTFGSGTKLEIK

SEQ ID NO: 398 - protein, 113 aa, Artificial Sequence
  Description of Artificial Sequence: Synthetic polypeptide
  mAb C[PD1]_L1.31
DIVMTQSPDSLAVSLGERATINCKSSQSLLNSGYQKNYLTWYQQKPGQPPKLLIYWASTRESGVPDRFTGSGSGTDFTLTISSLQAEDVAVYYCQNDYSYPFTFGSGTKLEIK

SEQ ID NO: 399 - protein, 113 aa, Artificial Sequence
  Description of Artificial Sequence: Synthetic polypeptide
  mAb C[PD1]_L1.32
DIVMTQSPDSLAVSLGERATINCKSSQSLLNSGNEKNYLTWYQQKPGQPPKLLIYWASTRESGVPDRFTGSGSGTDFTLTISSLQAEDVAVYYCQNDYSYPFTFGSGTKLEIK

SEQ ID NO: 400 - protein, 113 aa, Artificial Sequence
  Description of Artificial Sequence: Synthetic polypeptide
  mAb C[PD1]_L1.33
DIVMTQSPDSLAVSLGERATINCKSSQSLLNSGNHKNYLTWYQQKPGQPPKLLIYWASTRESGVPDRFTGSGSGTDFTLTISSLQAEDVAVYYCQNDYSYPFTFGSGTKLEIK

SEQ ID NO: 401 - protein, 113 aa, Artificial Sequence
  Description of Artificial Sequence: Synthetic polypeptide
  mAb C[PD1]_L1.34
DIVMTQSPDSLAVSLGERATINCKSSQSLLNSGNNKNYLTWYQQKPGQPPKLLIYWASTRESGVPDRFTGSGSGTDFTLTISSLQAEDVAVYYCQNDYSYPFTFGSGTKLEIK

SEQ ID NO: 402 - protein, 113 aa, Artificial Sequence
  Description of Artificial Sequence: Synthetic polypeptide
  mAb C[PD1]_L1.35
DIVMTQSPDSLAVSLGERATINCKSSQSLLNSGNKKNYLTWYQQKPGQPPKLLIYWASTRESGVPDRFTGSGSGTDFTLTISSLQAEDVAVYYCQNDYSYPFTFGSGTKLEIK

SEQ ID NO: 403 - protein, 113 aa, Artificial Sequence
  Description of Artificial Sequence: Synthetic polypeptide
  mAb C[PD1]_L1.36
DIVMTQSPDSLAVSLGERATINCKSSQSLLNSGNAKNYLTWYQQKPGQPPKLLIYWASTRESGVPDRFTGSGSGTDFTLTISSLQAEDVAVYYCQNDYSYPFTFGSGTKLEIK

SEQ ID NO: 404 - protein, 113 aa, Artificial Sequence
  Description of Artificial Sequence: Synthetic polypeptide
  mAb C[PD1]_L1.37
DIVMTQSPDSLAVSLGERATINCKSSQSLLNSGNFKNYLTWYQQKPGQPPKLLIYWASTRESGVPDRFTGSGSGTDFTLTISSLQAEDVAVYYCQNDYSYPFTFGSGTKLEIK

SEQ ID NO: 405 - protein, 113 aa, Artificial Sequence
  Description of Artificial Sequence: Synthetic polypeptide
  mAb C[PD1]_L1.38
DIVMTQSPDSLAVSLGERATINCKSSQSLLNSGNIKNYLTWYQQKPGQPPKLLIYWASTRESGVPDRFTGSGSGTDFTLTISSLQAEDVAVYYCQNDYSYPFTFGSGTKLEIK

SEQ ID NO: 406 - protein, 113 aa, Artificial Sequence
  Description of Artificial Sequence: Synthetic polypeptide
  mAb C[PD1]_L1.39
DIVMTQSPDSLAVSLGERATINCKSSQSLLNSGNQRNYLTWYQQKPGQPPKLLIYWASTRESGVPDRFTGSGSGTDFTLTISSLQAEDVAVYYCQNDYSYPFTFGSGTKLEIK

SEQ ID NO: 407 - protein, 113 aa, Artificial Sequence
  Description of Artificial Sequence: Synthetic polypeptide
  mAb C[PD1]_L1.40
DIVMTQSPDSLAVSLGERATINCKSSQSLLNSGNQENYLTWYQQKPGQPPKLLIYWASTRESGVPDRFTGSGSGTDFTLTISSLQAEDVAVYYCQNDYSYPFTFGSGTKLEIK

SEQ ID NO: 408 - protein, 113 aa, Artificial Sequence
  Description of Artificial Sequence: Synthetic polypeptide
  mAb C[PD1]_L1.41
DIVMTQSPDSLAVSLGERATINCKSSQSLLNSGNQHNYLTWYQQKPGQPPKLLIYWASTRESGVPDRFTGSGSGTDFTLTISSLQAEDVAVYYCQNDYSYPFTFGSGTKLEIK

SEQ ID NO: 409 - protein, 113 aa, Artificial Sequence
  Description of Artificial Sequence: Synthetic polypeptide
  mAb C[PD1]_L1.42
DIVMTQSPDSLAVSLGERATINCKSSQSLLNSGNQDNYLTWYQQKPGQPPKLLIYWASTRESGVPDRFTGSGSGTDFTLTISSLQAEDVAVYYCQNDYSYPFTFGSGTKLEIK

SEQ ID NO: 410 - protein, 113 aa, Artificial Sequence
  Description of Artificial Sequence: Synthetic polypeptide
  mAb C[PD1]_L1.43
DIVMTQSPDSLAVSLGERATINCKSSQSLLNSGNQANYLTWYQQKPGQPPKLLIYWASTRESGVPDRFTGSGSGTDFTLTISSLQAEDVAVYYCQNDYSYPFTFGSGTKLEIK

SEQ ID NO: 411 - protein, 113 aa, Artificial Sequence
  Description of Artificial Sequence: Synthetic polypeptide
  mAb C[PD1]_L1.44
DIVMTQSPDSLAVSLGERATINCKSSQSLLNSGNQGNYLTWYQQKPGQPPKLLIYWASTRESGVPDRFTGSGSGTDFTLTISSLQAEDVAVYYCQNDYSYPFTFGSGTKLEIK

SEQ ID NO: 412 - protein, 113 aa, Artificial Sequence
  Description of Artificial Sequence: Synthetic polypeptide
  mAb C[PD1]_L1.45
DIVMTQSPDSLAVSLGERATINCKSSQSLLNSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 413 - protein, 113 aa, Artificial Sequence
  Description of Artificial Sequence: Synthetic polypeptide
  mAb C[PD1]_L1.46
DIVMTQSPDSLAVSLGERATINCKSSQSLLNSGNQINYLTWYQQKPGQPPKLLIYWASTRESGVPDRFTGSGSGTDFTLTISSLQAEDVAVYYCQNDYSYPFTFGSGTKLEIK

SEQ ID NO: 414 - protein, 113 aa, Artificial Sequence
  Description of Artificial Sequence: Synthetic polypeptide
  mAb C[PD1]_L1.47
DIVMTQSPDSLAVSLGERATINCKSSQSLLNSGNQKDYLTWYQQKPGQPPKLLIYWASTRESGVPDRFTGSGSGTDFTLTISSLQAEDVAVYYCQNDYSYPFTFGSGTKLEIK

SEQ ID NO: 415 - protein, 113 aa, Artificial Sequence
  Description of Artificial Sequence: Synthetic polypeptide
  mAb C[PD1]_L1.48
DIVMTQSPDSLAVSLGERATINCKSSQSLLNSGNQKHYLTWYQQKPGQPPKLLIYWASTRESGVPDRFTGSGSGTDFTLTISSLQAEDVAVYYCQNDYSYPFTFGSGTKLEIK

SEQ ID NO: 416 - protein, 113 aa, Artificial Sequence
  Description of Artificial Sequence: Synthetic polypeptide
  mAb C[PD1]_L1.49
DIVMTQSPDSLAVSLGERATINCKSSQSLLNSGNQKEYLTWYQQKPGQPPKLLIYWASTRESGVPDRFTGSGSGTDFTLTISSLQAEDVAVYYCQNDYSYPFTFGSGTKLEIK

SEQ ID NO: 417 - protein, 113 aa, Artificial Sequence
  Description of Artificial Sequence: Synthetic polypeptide
  mAb C[PD1]_L1.50
DIVMTQSPDSLAVSLGERATINCKSSQSLLNSGNQKSYLTWYQQKPGQPPKLLIYWASTRESGVPDRFTGSGSGTDFTLTISSLQAEDVAVYYCQNDYSYPFTFGSGTKLEIK

SEQ ID NO: 418 - protein, 113 aa, Artificial Sequence
  Description of Artificial Sequence: Synthetic polypeptide
  mAb C[PD1]_L1.51
DIVMTQSPDSLAVSLGERATINCKSSQSLLNSGNQKRYLTWYQQKPGQPPKLLIYWASTRESGVPDRFTGSGSGTDFTLTISSLQAEDVAVYYCQNDYSYPFTFGSGTKLEIK

SEQ ID NO: 419 - protein, 113 aa, Artificial Sequence
  Description of Artificial Sequence: Synthetic polypeptide
  mAb C[PD1]_L1.52
DIVMTQSPDSLAVSLGERATINCKSSQSLLNSGNQKLYLTWYQQKPGQPPKLLIYWASTRESGVPDRFTGSGSGTDFTLTISSLQAEDVAVYYCQNDYSYPFTFGSGTKLEIK

SEQ ID NO: 420 - protein, 113 aa, Artificial Sequence
  Description of Artificial Sequence: Synthetic polypeptide
  mAb C[PD1]_L1.53
DIVMTQSPDSLAVSLGERATINCKSSQSLLNSGNQKTYLTWYQQKPGQPPKLLIYWASTRESGVPDRFTGSGSGTDFTLTISSLQAEDVAVYYCQNDYSYPFTFGSGTKLEIK

SEQ ID NO: 421 - protein, 113 aa, Artificial Sequence
  Description of Artificial Sequence: Synthetic polypeptide
  mAb C[PD1]_L1.54
DIVMTQSPDSLAVSLGERATINCKSSQSLLNSGNQKGYLTWYQQKPGQPPKLLIYWASTRESGVPDRFTGSGSGTDFTLTISSLQAEDVAVYYCQNDYSYPFTFGSGTKLEIK

SEQ ID NO: 422 - protein, 113 aa, Artificial Sequence
  Description of Artificial Sequence: Synthetic polypeptide
  mAb C[PD1]_L1.55
DIVMTQSPDSLAVSLGERATINCKSSQSLLNSGNQKYYLTWYQQKPGQPPKLLIYWASTRESGVPDRFTGSGSGTDFTLTISSLQAEDVAVYYCQNDYSYPFTFGSGTKLEIK

SEQ ID NO: 423 - protein, 113 aa, Artificial Sequence
  Description of Artificial Sequence: Synthetic polypeptide
  mAb C[PD1]_L1.56
DIVMTQSPDSLAVSLGERATINCKSSQSLLNSGNQKNFLTWYQQKPGQPPKLLIYWASTRESGVPDRFTGSGSGTDFTLTISSLQAEDVAVYYCQNDYSYPFTFGSGTKLEIK

SEQ ID NO: 424 - protein, 113 aa, Artificial Sequence
  Description of Artificial Sequence: Synthetic polypeptide
  mAb C[PD1]_L1.57
DIVMTQSPDSLAVSLGERATINCKSSQSLLNSGNQKNHLTWYQQKPGQPPKLLIYWASTRESGVPDRFTGSGSGTDFTLTISSLQAEDVAVYYCQNDYSYPFTFGSGTKLEIK

SEQ ID NO: 425 - protein, 113 aa, Artificial Sequence
  Description of Artificial Sequence: Synthetic polypeptide
  mAb C[PD1]_L1.58
DIVMTQSPDSLAVSLGERATINCKSSQSLLNSGNQKNLLTWYQQKPGQPPKLLIYWASTRESGVPDRFTGSGSGTDFTLTISSLQAEDVAVYYCQNDYSYPFTFGSGTKLEIK

SEQ ID NO: 426 - protein, 113 aa, Artificial Sequence
  Description of Artificial Sequence: Synthetic polypeptide
  mAb C[PD1]_L1.59
DIVMTQSPDSLAVSLGERATINCKSSQSLLNSGNQKNWLTWYQQKPGQPPKLLIYWASTRESGVPDRFTGSGSGTDFTLTISSLQAEDVAVYYCQNDYSYPFTFGSGTKLEIK

SEQ ID NO: 427 - protein, 113 aa, Artificial Sequence
  Description of Artificial Sequence: Synthetic polypeptide
  mAb C[PD1]_L1.60
DIVMTQSPDSLAVSLGERATINCKSSQSLLNSGNQKNVLTWYQQKPGQPPKLLIYWASTRESGVPDRFTGSGSGTDFTLTISSLQAEDVAVYYCQNDYSYPFTFGSGTKLEIK

SEQ ID NO: 428 - protein, 113 aa, Artificial Sequence
  Description of Artificial Sequence: Synthetic polypeptide
  mAb C[PD1]_L1.61
DIVMTQSPDSLAVSLGERATINCKSSQSLLNSGNQKNALTWYQQKPGQPPKLLIYWASTRESGVPDRFTGSGSGTDFTLTISSLQAEDVAVYYCQNDYSYPFTFGSGTKLEIK

SEQ ID NO: 429 - protein, 113 aa, Artificial Sequence
  Description of Artificial Sequence: Synthetic polypeptide
  mAb C[PD1]_L1.62
DIVMTQSPDSLAVSLGERATINCKSSQSLLNSGNQKNQLTWYQQKPGQPPKLLIYWASTRESGVPDRFTGSGSGTDFTLTISSLQAEDVAVYYCQNDYSYPFTFGSGTKLEIK

SEQ ID NO: 430 - protein, 113 aa, Artificial Sequence
  Description of Artificial Sequence: Synthetic polypeptide
  mAb C[PD1]_L1.63
DIVMTQSPDSLAVSLGERATINCKSSQSLLNSGNQKNDLTWYQQKPGQPPKLLIYWASTRESGVPDRFTGSGSGTDFTLTISSLQAEDVAVYYCQNDYSYPFTFGSGTKLEIK

SEQ ID NO: 431 - protein, 113 aa, Artificial Sequence
  Description of Artificial Sequence: Synthetic polypeptide
  mAb C[PD1]_L1.64
DIVMTQSPDSLAVSLGERATINCKSSQSLLNSGNQKNKLTWYQQKPGQPPKLLIYWASTRESGVPDRFTGSGSGTDFTLTISSLQAEDVAVYYCQNDYSYPFTFGSGTKLEIK

SEQ ID NO: 432 - protein, 113 aa, Artificial Sequence
  Description of Artificial Sequence: Synthetic polypeptide
  mAb C[PD1]_L1.65
DIVMTQSPDSLAVSLGERATINCKSSQSLLNSGNQKNYLAWYQQKPGQPPKLLIYWASTRESGVPDRFTGSGSGTDFTLTISSLQAEDVAVYYCQNDYSYPFTFGSGTKLEIK

SEQ ID NO: 433 - protein, 113 aa, Artificial Sequence
  Description of Artificial Sequence: Synthetic polypeptide
  mAb C[PD1]_L1.66
DIVMTQSPDSLAVSLGERATINCKSSQSLLNSGNQKNYLTWYQQKPGQPPKLLIYFASTRESGVPDRFTGSGSGTDFTLTISSLQAEDVAVYYCQNDYSYPFTFGSGTKLEIK

SEQ ID NO: 434 - protein, 113 aa, Artificial Sequence
  Description of Artificial Sequence: Synthetic polypeptide
  mAb C[PD1]_L1.67
DIVMTQSPDSLAVSLGERATINCKSSQSLLNSGNQKNYLTWYQQKPGQPPKLLIYLASTRESGVPDRFTGSGSGTDFTLTISSLQAEDVAVYYCQNDYSYPFTFGSGTKLEIK

SEQ ID NO: 435 - protein, 113 aa, Artificial Sequence
  Description of Artificial Sequence: Synthetic polypeptide
  mAb C[PD1]_L1.68
DIVMTQSPDSLAVSLGERATINCKSSQSLLNSGNQKNYLTWYQQKPGQPPKLLIYYASTRESGVPDRFTGSGSGTDFTLTISSLQAEDVAVYYCQNDYSYPFTFGSGTKLEIK

SEQ ID NO: 436 - protein, 113 aa, Artificial Sequence
  Description of Artificial Sequence: Synthetic polypeptide
  mAb C[PD1]_L1.69
DIVMTQSPDSLAVSLGERATINCKSSQSLLNSGNQKNYLTWYQQKPGQPPKLLIYIASTRESGVPDRFTGSGSGTDFTLTISSLQAEDVAVYYCQNDYSYPFTFGSGTKLEIK

SEQ ID NO: 437 - protein, 113 aa, Artificial Sequence
  Description of Artificial Sequence: Synthetic polypeptide
  mAb C[PD1]_L1.70
DIVMTQSPDSLAVSLGERATINCKSSQSLLNSGNQKNYLTWYQQKPGQPPKLLIYHASTRESGVPDRFTGSGSGTDFTLTISSLQAEDVAVYYCQNDYSYPFTFGSGTKLEIK

SEQ ID NO: 438 - protein, 113 aa, Artificial Sequence
  Description of Artificial Sequence: Synthetic polypeptide
  mAb C[PD1]_L1.71
DIVMTQSPDSLAVSLGERATINCKSSQSLLNSGNQKNYLTWYQQKPGQPPKLLIYQASTRESGVPDRFTGSGSGTDFTLTISSLQAEDVAVYYCQNDYSYPFTFGSGTKLEIK

SEQ ID NO: 439 - protein, 113 aa, Artificial Sequence
  Description of Artificial Sequence: Synthetic polypeptide
  mAb C[PD1]_L1.72
DIVMTQSPDSLAVSLGERATINCKSSQSLLNSGNQKNYLTWYQQKPGQPPKLLIYSASTRESGVPDRFTGSGSGTDFTLTISSLQAEDVAVYYCQNDYSYPFTFGSGTKLEIK

SEQ ID NO: 440 - protein, 113 aa, Artificial Sequence
  Description of Artificial Sequence: Synthetic polypeptide
  mAb C[PD1]_L1.73
DIVMTQSPDSLAVSLGERATINCKSSQSLLNSGNQKNYLTWYQQKPGQPPKLLIYDASTRESGVPDRFTGSGSGTDFTLTISSLQAEDVAVYYCQNDYSYPFTFGSGTKLEIK

SEQ ID NO: 441 - protein, 113 aa, Artificial Sequence
  Description of Artificial Sequence: Synthetic polypeptide
  mAb C[PD1]_L1.74
DIVMTQSPDSLAVSLGERATINCKSSQSLLNSGNQKNYLTWYQQKPGQPPKLLIYRASTRESGVPDRFTGSGSGTDFTLTISSLQAEDVAVYYCQNDYSYPFTFGSGTKLEIK

SEQ ID NO: 442 - protein, 113 aa, Artificial Sequence
  Description of Artificial Sequence: Synthetic polypeptide
  mAb C[PD1]_L1.75
DIVMTQSPDSLAVSLGERATINCKSSQSLLNSGNQKNYLTWYQQKPGQPPKLLIYWASVRESGVPDRFTGSGSGTDFTLTISSLQAEDVAVYYCQNDYSYPFTFGSGTKLEIK

SEQ ID NO: 443 - protein, 113 aa, Artificial Sequence
  Description of Artificial Sequence: Synthetic polypeptide
  mAb C[PD1]_L1.76
DIVMTQSPDSLAVSLGERATINCKSSQSLLNSGNQKNYLTWYQQKPGQPPKLLIYWASSRESGVPDRFTGSGSGTDFTLTISSLQAEDVAVYYCQNDYSYPFTFGSGTKLEIK

SEQ ID NO: 444 - protein, 113 aa, Artificial Sequence
  Description of Artificial Sequence: Synthetic polypeptide
  mAb C[PD1]_L1.77
DIVMTQSPDSLAVSLGERATINCKSSQSLLNSGNQKNYLTWYQQKPGQPPKLLIYWASARESGVPDRFTGSGSGTDFTLTISSLQAEDVAVYYCQNDYSYPFTFGSGTKLEIK

SEQ ID NO: 445 - protein, 113 aa, Artificial Sequence
  Description of Artificial Sequence: Synthetic polypeptide
  mAb C[PD1]_L1.78
DIVMTQSPDSLAVSLGERATINCKSSQSLLNSGNQKNYLTWYQQKPGQPPKLLIYWASIRESGVPDRFTGSGSGTDFTLTISSLQAEDVAVYYCQNDYSYPFTFGSGTKLEIK

SEQ ID NO: 446 - protein, 113 aa, Artificial Sequence
  Description of Artificial Sequence: Synthetic polypeptide
  mAb C[PD1]_L1.79
DIVMTQSPDSLAVSLGERATINCKSSQSLLNSGNQKNYLTWYQQKPGQPPKLLIYWASQRESGVPDRFTGSGSGTDFTLTISSLQAEDVAVYYCQNDYSYPFTFGSGTKLEIK

SEQ ID NO: 447 - protein, 113 aa, Artificial Sequence
  Description of Artificial Sequence: Synthetic polypeptide
  mAb C[PD1]_L1.80
DIVMTQSPDSLAVSLGERATINCKSSQSLLNSGNQKNYLTWYQQKPGQPPKLLIYWASHRESGVPDRFTGSGSGTDFTLTISSLQAEDVAVYYCQNDYSYPFTFGSGTKLEIK

SEQ ID NO: 448 - protein, 113 aa, Artificial Sequence
  Description of Artificial Sequence: Synthetic polypeptide
  mAb C[PD1]_L1.81
DIVMTQSPDSLAVSLGERATINCKSSQSLLNSGNQKNYLTWYQQKPGQPPKLLIYWASDRESGVPDRFTGSGSGTDFTLTISSLQAEDVAVYYCQNDYSYPFTFGSGTKLEIK

SEQ ID NO: 449 - protein, 113 aa, Artificial Sequence
  Description of Artificial Sequence: Synthetic polypeptide
  mAb C[PD1]_L1.82
DIVMTQSPDSLAVSLGERATINCKSSQSLLNSGNQKNYLTWYQQKPGQPPKLLIYWASKRESGVPDRFTGSGSGTDFTLTISSLQAEDVAVYYCQNDYSYPFTFGSGTKLEIK

SEQ ID NO: 450 - protein, 113 aa, Artificial Sequence
  Description of Artificial Sequence: Synthetic polypeptide
  mAb C[PD1]_L1.83
DIVMTQSPDSLAVSLGERATINCKSSQSLLNSGNQKNYLTWYQQKPGQPPKLLIYWASYRESGVPDRFTGSGSGTDFTLTISSLQAEDVAVYYCQNDYSYPFTFGSGTKLEIK

SEQ ID NO: 451 - protein, 113 aa, Artificial Sequence
  Description of Artificial Sequence: Synthetic polypeptide
  mAb C[PD1]_L1.84
DIVMTQSPDSLAVSLGERATINCKSSQSLLNSGNQKNYLTWYQQKPGQPPKLLIYWASTRQSGVPDRFTGSGSGTDFTLTISSLQAEDVAVYYCQNDYSYPFTFGSGTKLEIK

SEQ ID NO: 452 - protein, 113 aa, Artificial Sequence
  Description of Artificial Sequence: Synthetic polypeptide
  mAb C[PD1]_L1.85
DIVMTQSPDSLAVSLGERATINCKSSQSLLNSGNQKNYLTWYQQKPGQPPKLLIYWASTRKSGVPDRFTGSGSGTDFTLTISSLQAEDVAVYYCQNDYSYPFTFGSGTKLEIK

SEQ ID NO: 453 - protein, 113 aa, Artificial Sequence
  Description of Artificial Sequence: Synthetic polypeptide
  mAb C[PD1]_L1.86
DIVMTQSPDSLAVSLGERATINCKSSQSLLNSGNQKNYLTWYQQKPGQPPKLLIYWASTRSSGVPDRFTGSGSGTDFTLTISSLQAEDVAVYYCQNDYSYPFTFGSGTKLEIK

SEQ ID NO: 454 - protein, 113 aa, Artificial Sequence
  Description of Artificial Sequence: Synthetic polypeptide
  mAb C[PD1]_L1.87
DIVMTQSPDSLAVSLGERATINCKSSQSLLNSGNQKNYLTWYQQKPGQPPKLLIYWASTRHSGVPDRFTGSGSGTDFTLTISSLQAEDVAVYYCQNDYSYPFTFGSGTKLEIK

SEQ ID NO: 455 - protein, 113 aa, Artificial Sequence
  Description of Artificial Sequence: Synthetic polypeptide
  mAb C[PD1]_L1.88
DIVMTQSPDSLAVSLGERATINCKSSQSLLNSGNQKNYLTWYQQKPGQPPKLLIYWASTRASGVPDRFTGSGSGTDFTLTISSLQAEDVAVYYCQNDYSYPFTFGSGTKLEIK

SEQ ID NO: 456 - protein, 113 aa, Artificial Sequence
  Description of Artificial Sequence: Synthetic polypeptide
  mAb C[PD1]_L1.89
DIVMTQSPDSLAVSLGERATINCKSSQSLLNSGNQKNYLTWYQQKPGQPPKLLIYWASTRGSGVPDRFTGSGSGTDFTLTISSLQAEDVAVYYCQNDYSYPFTFGSGTKLEIK

SEQ ID NO: 457 - protein, 113 aa, Artificial Sequence
  Description of Artificial Sequence: Synthetic polypeptide
  mAb C[PD1]_L1.90
DIVMTQSPDSLAVSLGERATINCKSSQSLLNSGNQKNYLTWYQQKPGQPPKLLIYWASTRFSGVPDRFTGSGSGTDFTLTISSLQAEDVAVYYCQNDYSYPFTFGSGTKLEIK

SEQ ID NO: 458 - protein, 113 aa, Artificial Sequence
  Description of Artificial Sequence: Synthetic polypeptide
  mAb C[PD1]_L1.91
DIVMTQSPDSLAVSLGERATINCKSSQSLLNSGNQKNYLTWYQQKPGQPPKLLIYWASTRISGVPDRFTGSGSGTDFTLTISSLQAEDVAVYYCQNDYSYPFTFGSGTKLEIK

SEQ ID NO: 459 - protein, 113 aa, Artificial Sequence
  Description of Artificial Sequence: Synthetic polypeptide
  mAb C[PD1]_L1.92
DIVMTQSPDSLAVSLGERATINCKSSQSLLNSGNQKNYLTWYQQKPGQPPKLLIYWASTRETGVPDRFTGSGSGTDFTLTISSLQAEDVAVYYCQNDYSYPFTFGSGTKLEIK

SEQ ID NO: 460 - protein, 113 aa, Artificial Sequence
  Description of Artificial Sequence: Synthetic polypeptide
  mAb C[PD1]_L1.93
DIVMTQSPDSLAVSLGERATINCKSSQSLLNSGNQKNYLTWYQQKPGQPPKLLIYWASTREAGVPDRFTGSGSGTDFTLTISSLQAEDVAVYYCQNDYSYPFTFGSGTKLEIK

SEQ ID NO: 461 - protein, 113 aa, Artificial Sequence
  Description of Artificial Sequence: Synthetic polypeptide
  mAb C[PD1]_L1.94
DIVMTQSPDSLAVSLGERATINCKSSQSLLNSGNQKNYLTWYQQKPGQPPKLLIYWASTREQGVPDRFTGSGSGTDFTLTISSLQAEDVAVYYCQNDYSYPFTFGSGTKLEIK

SEQ ID NO: 462 - protein, 113 aa, Artificial Sequence
  Description of Artificial Sequence: Synthetic polypeptide
  mAb C[PD1]_L1.95
DIVMTQSPDSLAVSLGERATINCKSSQSLLNSGNQKNYLTWYQQKPGQPPKLLIYWASTREVGVPDRFTGSGSGTDFTLTISSLQAEDVAVYYCQNDYSYPFTFGSGTKLEIK

SEQ ID NO: 463 - protein, 113 aa, Artificial Sequence
  Description of Artificial Sequence: Synthetic polypeptide
  mAb C[PD1]_L1.96
DIVMTQSPDSLAVSLGERATINCKSSQSLLNSGNQKNYLTWYQQKPGQPPKLLIYWASTREHGVPDRFTGSGSGTDFTLTISSLQAEDVAVYYCQNDYSYPFTFGSGTKLEIK

SEQ ID NO: 464 - protein, 113 aa, Artificial Sequence
  Description of Artificial Sequence: Synthetic polypeptide
  mAb C[PD1]_L1.97
DIVMTQSPDSLAVSLGERATINCKSSQSLLNSGNQKNYLTWYQQKPGQPPKLLIYWASTREKGVPDRFTGSGSGTDFTLTISSLQAEDVAVYYCQNDYSYPFTFGSGTKLEIK

SEQ ID NO: 465 - protein, 113 aa, Artificial Sequence
  Description of Artificial Sequence: Synthetic polypeptide
  mAb C[PD1]_L1.98
DIVMTQSPDSLAVSLGERATINCKSSQSLLNSGNQKNYLTWYQQKPGQPPKLLIYWASTREYGVPDRFTGSGSGTDFTLTISSLQAEDVAVYYCQNDYSYPFTFGSGTKLEIK

SEQ ID NO: 466 - protein, 113 aa, Artificial Sequence
  Description of Artificial Sequence: Synthetic polypeptide
  mAb C[PD1]_L1.99
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPFTFGSGTKLEIK

SEQ ID NO: 467 - protein, 113 aa, Artificial Sequence
  Description of Artificial Sequence: Synthetic polypeptide
  mAb C[PD1]_L1.100
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNQYSYPFTFGSGTKLEIK

SEQ ID NO: 468 - protein, 113 aa, Artificial Sequence
  Description of Artificial Sequence: Synthetic polypeptide
  mAb C[PD1]_L1.101
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNEYSYPFTFGSGTKLEIK

SEQ ID NO: 469 - protein, 113 aa, Artificial Sequence
  Description of Artificial Sequence: Synthetic polypeptide
  mAb C[PD1]_L1.102
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNHYSYPFTFGSGTKLEIK

SEQ ID NO: 470 - protein, 113 aa, Artificial Sequence
  Description of Artificial Sequence: Synthetic polypeptide
  mAb C[PD1]_L1.103
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNSYSYPFTFGSGTKLEIK

SEQ ID NO: 471 - protein, 113 aa, Artificial Sequence
  Description of Artificial Sequence: Synthetic polypeptide
  mAb C[PD1]_L1.104
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNRYSYPFTFGSGTKLEIK

SEQ ID NO: 472 - protein, 113 aa, Artificial Sequence
  Description of Artificial Sequence: Synthetic polypeptide
  mAb C[PD1]_L1.105
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNLYSYPFTFGSGTKLEIK

SEQ ID NO: 473 - protein, 113 aa, Artificial Sequence
  Description of Artificial Sequence: Synthetic polypeptide
  mAb C[PD1]_L1.106
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNTYSYPFTFGSGTKLEIK

SEQ ID NO: 474 - protein, 113 aa, Artificial Sequence
  Description of Artificial Sequence: Synthetic polypeptide
  mAb C[PD1]_L1.107
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNGYSYPFTFGSGTKLEIK

SEQ ID NO: 475 - protein, 113 aa, Artificial Sequence
  Description of Artificial Sequence: Synthetic polypeptide
  mAb C[PD1]_L1.108
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNYYSYPFTFGSGTKLEIK

SEQ ID NO: 476 - protein, 113 aa, Artificial Sequence
  Description of Artificial Sequence: Synthetic polypeptide
  mAb C[PD1]_L1.109
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDFSYPFTFGSGTKLEIK

SEQ ID NO: 477 - protein, 113 aa, Artificial Sequence
  Description of Artificial Sequence: Synthetic polypeptide
  mAb C[PD1]_L1.110
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDHSYPFTFGSGTKLEIK

SEQ ID NO: 478 - protein, 113 aa, Artificial Sequence
  Description of Artificial Sequence: Synthetic polypeptide
  mAb C[PD1]_L1.111
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDLSYPFTFGSGTKLEIK

SEQ ID NO: 479 - protein, 113 aa, Artificial Sequence
  Description of Artificial Sequence: Synthetic polypeptide
  mAb C[PD1]_L1.112
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDWSYPFTFGSGTKLEIK

SEQ ID NO: 480 - protein, 113 aa, Artificial Sequence
  Description of Artificial Sequence: Synthetic polypeptide
  mAb C[PD1]_L1.113
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDVSYPFTFGSGTKLEIK

SEQ ID NO: 481 - protein, 113 aa, Artificial Sequence
  Description of Artificial Sequence: Synthetic polypeptide
  mAb C[PD1]_L1.114
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDASYPFTFGSGTKLEIK

SEQ ID NO: 482 - protein, 113 aa, Artificial Sequence
  Description of Artificial Sequence: Synthetic polypeptide
  mAb C[PD1]_L1.115
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDQSYPFTFGSGTKLEIK

SEQ ID NO: 483 - protein, 113 aa, Artificial Sequence
  Description of Artificial Sequence: Synthetic polypeptide
  mAb C[PD1]_L1.116
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDKSYPFTFGSGTKLEIK

SEQ ID NO: 484 - protein, 113 aa, Artificial Sequence
  Description of Artificial Sequence: Synthetic polypeptide
  mAb C[PD1]_L1.117
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 485 - protein, 113 aa, Artificial Sequence
  Description of Artificial Sequence: Synthetic polypeptide
  mAb C[PD1]_L1.118
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYAYPFTFGSGTKLEIK

SEQ ID NO: 486 - protein, 113 aa, Artificial Sequence
  Description of Artificial Sequence: Synthetic polypeptide
  mAb C[PD1]_L1.119
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYQYPFTFGSGTKLEIK

SEQ ID NO: 487 - protein, 113 aa, Artificial Sequence
  Description of Artificial Sequence: Synthetic polypeptide
  mAb C[PD1]_L1.120
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYGYPFTFGSGTKLEIK

SEQ ID NO: 488 - protein, 113 aa, Artificial Sequence
  Description of Artificial Sequence: Synthetic polypeptide
  mAb C[PD1]_L1.121
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYVYPFTFGSGTKLEIK

SEQ ID NO: 489 - protein, 113 aa, Artificial Sequence
  Description of Artificial Sequence: Synthetic polypeptide
  mAb C[PD1]_L1.122
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYHYPFTFGSGTKLEIK

SEQ ID NO: 490 - protein, 113 aa, Artificial Sequence
  Description of Artificial Sequence: Synthetic polypeptide
  mAb C[PD1]_L1.123
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYDYPFTFGSGTKLEIK

SEQ ID NO: 491 - protein, 113 aa, Artificial Sequence
  Description of Artificial Sequence: Synthetic polypeptide
  mAb C[PD1]_L1.124
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYKYPFTFGSGTKLEIK

SEQ ID NO: 492 - protein, 113 aa, Artificial Sequence
  Description of Artificial Sequence: Synthetic polypeptide
  mAb C[PD1]_L1.125
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYFYPFTFGSGTKLEIK

SEQ ID NO: 493 - protein, 113 aa, Artificial Sequence
  Description of Artificial Sequence: Synthetic polypeptide
  mAb C[PD1]_L1.126
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSFPFTFGSGTKLEIK

SEQ ID NO: 494 - protein, 113 aa, Artificial Sequence
  Description of Artificial Sequence: Synthetic polypeptide
  mAb C[PD1]_L1.127
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSHPFTFGSGTKLEIK

SEQ ID NO: 495 - protein, 113 aa, Artificial Sequence
  Description of Artificial Sequence: Synthetic polypeptide
  mAb C[PD1]_L1.128
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSLPFTFGSGTKLEIK

SEQ ID NO: 496 - protein, 113 aa, Artificial Sequence
  Description of Artificial Sequence: Synthetic polypeptide
  mAb C[PD1]_L1.129
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSWPFTFGSGTKLEIK

SEQ ID NO: 497 - protein, 113 aa, Artificial Sequence
  Description of Artificial Sequence: Synthetic polypeptide
  mAb C[PD1]_L1.130
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSVPFTFGSGTKLEIK

SEQ ID NO: 498 - protein, 113 aa, Artificial Sequence
  Description of Artificial Sequence: Synthetic polypeptide
  mAb C[PD1]_L1.131
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSAPFTFGSGTKLEIK

SEQ ID NO: 499 - protein, 113 aa, Artificial Sequence
  Description of Artificial Sequence: Synthetic polypeptide
  mAb C[PD1]_L1.132
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSQPFTFGSGTKLEIK

SEQ ID NO: 500 - protein, 113 aa, Artificial Sequence
  Description of Artificial Sequence: Synthetic polypeptide
  mAb C[PD1]_L1.133
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSDPFTFGSGTKLEIK

SEQ ID NO: 501 - protein, 113 aa, Artificial Sequence
  Description of Artificial Sequence: Synthetic polypeptide
  mAb C[PD1]_L1.134
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSKPFTFGSGTKLEIK

SEQ ID NO: 502 - protein, 119 aa, Artificial Sequence; identical to SEQ ID NO: 5
  Description of Artificial Sequence: Synthetic polypeptide
  mAb C[PD-1]_H1 Variable Heavy

SEQ ID NO: 503 - protein, 119 aa, Artificial Sequence; identical to SEQ ID NO: 218
  Description of Artificial Sequence: Synthetic polypeptide
  mAb C[PD-1]_H1.19 Variable Heavy

SEQ ID NO: 504 - protein, 119 aa, Artificial Sequence; identical to SEQ ID NO: 247
  Description of Artificial Sequence: Synthetic polypeptide
  mAb C[PD-1]_H1.48 Variable Heavy

SEQ ID NO: 505 - protein, 119 aa, Artificial Sequence; identical to SEQ ID NO: 324
  Description of Artificial Sequence: Synthetic polypeptide
  mAb C[PD-1]_H1.125 Variable Heavy

SEQ ID NO: 506 - protein, 119 aa, Artificial Sequence; identical to SEQ ID NO: 329
  Description of Artificial Sequence: Synthetic polypeptide
  mAb C[PD-1]_H1.130 Variable Heavy

SEQ ID NO: 507 - protein, 119 aa, Artificial Sequence; identical to SEQ ID NO: 331
  Description of Artificial Sequence: Synthetic polypeptide
  mAb C[PD-1]_H1.132 Variable Heavy

SEQ ID NO: 508 - protein, 119 aa, Artificial Sequence
  Description of Artificial Sequence: Synthetic polypeptide
  mAb C[PD-1]_H1.169 Variable Heavy
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 509 - protein, 119 aa, Artificial Sequence
  Description of Artificial Sequence: Synthetic polypeptide
  mAb C[PD-1]_H1.175 Variable Heavy
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGWLVWSPDYWGQGTLVTVSS

SEQ ID NO: 510 - protein, 119 aa, Artificial Sequence
  Description of Artificial Sequence: Synthetic polypeptide
  mAb C[PD-1]_H2 Variable Heavy
EVQLVESGGGLVKPGGSLRLSCAASGFTFSSFGMHWVRQAPGKGLEWVGYISSGSSIIYYADPVKGRFTISRDNSKNTLYLQMNSLKTEDTAVYYCARGGRLVWSPDYWGQGTLVTVSS

SEQ ID NO: 511 - protein, 113 aa, Artificial Sequence; identical to SEQ ID NO: 6
  Description of Artificial Sequence: Synthetic polypeptide
  mAb C[PD-1]_L1 Variable Light

SEQ ID NO: 512 - protein, 113 aa, Artificial Sequence; identical to SEQ ID NO: 368
  Description of Artificial Sequence: Synthetic polypeptide
  mAb C[PD-1]_L1.1 Variable Light

SEQ ID NO: 513 - protein, 113 aa, Artificial Sequence; identical to SEQ ID NO: 370
  Description of Artificial Sequence: Synthetic polypeptide
  mAb C[PD-1]_L1.3 Variable Light

SEQ ID NO: 514 - protein, 113 aa, Artificial Sequence; identical to SEQ ID NO: 412
  Description of Artificial Sequence: Synthetic polypeptide
  mAb C[PD-1]_L1.45 Variable Light

SEQ ID NO: 515 - protein, 113 aa, Artificial Sequence; identical to SEQ ID NO: 484
  Description of Artificial Sequence: Synthetic polypeptide
  mAb C[PD-1]_L1.117 Variable Light

SEQ ID NO: 516 - protein, 113 aa, Artificial Sequence; identical to SEQ ID NO: 496
  Description of Artificial Sequence: Synthetic polypeptide
  mAb C[PD-1]_L1.129 Variable Light

SEQ ID NO: 517 - protein, 113 aa, Artificial Sequence
  Description of Artificial Sequence: Synthetic polypeptide
  mAb C[PD-1]_L1.135 Variable Light
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 518 - protein, 113 aa, Artificial Sequence
  Description of Artificial Sequence: Synthetic polypeptide
  mAb C[PD-1]_L1.136 Variable Light
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 519 - protein, 113 aa, Artificial Sequence
  Description of Artificial Sequence: Synthetic polypeptide
  mAb C[PD-1]_L1.140 Variable Light
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYTYPFTFGSGTKLEIK

SEQ ID NO: 520 - protein, 113 aa, Artificial Sequence
  Description of Artificial Sequence: Synthetic polypeptide
  mAb C[PD-1]_L2 Variable Light
DIVMTQSPLSLPVTPGEPASISCRSSQSLLNSGNQKNYLTWYLQKPGQPPQLLIYWASTRESGVPDRFTGSGSGTDFTLKISRVEAEDVGVYYCQNDYSYPFTFGSGTKLEIK

SEQ ID NO: 521 - protein, 448 aa, Artificial Sequence
  Description of Artificial Sequence: Synthetic polypeptide
  XENP28536 Chain 1 - mAb C[PD-1]_H1_IgG1_PVA_/S267K Heavy Chain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 220 aa, Artificial Sequence
  Description of Artificial Sequence: Synthetic polypeptide
  XENP28536 Chain 2 - mAb C[PD-1]_L1 Light Chain
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - protein, 448 aa, Artificial Sequence; identical to SEQ ID NO: 521
  Description of Artificial Sequence: Synthetic polypeptide
  XENP28537 Chain 1 - mAb C[PD-1]_H1_IgG1_PVA_/S267K Heavy Chain

SEQ ID NO: 524 - protein, 220 aa, Artificial Sequence
  Description of Artificial Sequence: Synthetic polypeptide
  XENP28537 Chain 2 - mAb C[PD-1]_L2 Light Chain
DIVMTQSPLSLPVTPGEPASISCRSSQSLLNSGNQKNYLTWYLQKPGQPPQLLIYWASTRESGVPDRFTGSGSGTDFTLKISRVEAEDVGVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 525 - protein, 448 aa, Artificial Sequence
  Description of Artificial Sequence: Synthetic polypeptide
  XENP28538 Chain 1 - mAb C[PD-1]_H2_IgG1_PVA_/S267K Heavy Chain
EVQLVESGGGLVKPGGSLRLSCAASGFTFSSFGMHWVRQAPGKGLEWVGYISSGSSIIYYADPVKGRFTISRDNSKNTLYLQMNSLKTEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 220 aa, Artificial Sequence; identical to SEQ ID NO: 522
  Description of Artificial Sequence: Synthetic polypeptide
  XENP28538 Chain 2 - mAb C[PD-1]_L1 Light Chain

SEQ ID NO: 527 - protein, 448 aa, Artificial Sequence; identical to SEQ ID NO: 525
  Description of Artificial Sequence: Synthetic polypeptide
  XENP28539 Chain 1 - mAb C[PD-1]_H2_IgG1_PVA_/S267K Heavy Chain

SEQ ID NO: 528 - protein, 220 aa, Artificial Sequence; identical to SEQ ID NO: 524
  Description of Artificial Sequence: Synthetic polypeptide
  XENP28539 Chain 2 - mAb C[PD-1]_L2 Light Chain

SEQ ID NO: 529 - protein, 435 aa, Artificial Sequence; identical to SEQ ID NO: 136
  Description of Artificial Sequence: Synthetic polypeptide
  XENP28543 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 530 - protein, 448 aa, Artificial Sequence
  Description of Artificial Sequence: Synthetic polypeptide
  XENP28543 Chain 2 -  mAb C[PD-1]_H1_IgG1_PVA_/S267K/ S364K/E357Q
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 531 - protein, 220 aa, Artificial Sequence; identical to SEQ ID NO: 522
  Description of Artificial Sequence: Synthetic polypeptide
  XENP28543 Chain 3 -  mAb C[PD-1]_L1

SEQ ID NO: 532 - protein, 435 aa, Artificial Sequence; identical to SEQ ID NO: 140
  Description of Artificial Sequence: Synthetic polypeptide
  XENP29483 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 533 - protein, 448 aa, Artificial Sequence; identical to SEQ ID NO: 530
  Description of Artificial Sequence: Synthetic polypeptide
  XENP29483 Chain 2 -  mAb C[PD-1]_H1_IgG1_PVA_/S267K/ S364K/E357Q

SEQ ID NO: 534 - protein, 220 aa, Artificial Sequence; identical to SEQ ID NO: 522
  Description of Artificial Sequence: Synthetic polypeptide
  XENP29483 Chain 3 -  mAb C[PD-1]_L1

SEQ ID NO: 535 - protein, 435 aa, Artificial Sequence; identical to SEQ ID NO: 142
  Description of Artificial Sequence: Synthetic polypeptide
  XENP30428 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S

SEQ ID NO: 536 - protein, 448 aa, Artificial Sequence; identical to SEQ ID NO: 530
  Description of Artificial Sequence: Synthetic polypeptide
  XENP30428 Chain 2 -  mAb C[PD-1]_H1_IgG1_PVA_/S267K/ S364K/E357Q

SEQ ID NO: 537 - protein, 220 aa, Artificial Sequence; identical to SEQ ID NO: 522
  Description of Artificial Sequence: Synthetic polypeptide
  XENP30428 Chain 3 -  mAb C[PD-1]_L1

SEQ ID NO: 538 - protein, 435 aa, Artificial Sequence; identical to SEQ ID NO: 142
  Description of Artificial Sequence: Synthetic polypeptide
  XENP30429 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S

SEQ ID NO: 539 - protein, 448 aa, Artificial Sequence; identical to SEQ ID NO: 530
  Description of Artificial Sequence: Synthetic polypeptide
  XENP30429 Chain 2 -  mAb C[PD-1]_H1_IgG1_PVA_/S267K/ S364K/E357Q

SEQ ID NO: 540 - protein, 220 aa, Artificial Sequence
  Description of Artificial Sequence: Synthetic polypeptide
  XENP30429 Chain 3 -  mAb C[PD-1]_L1.1
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 541 - protein, 435 aa, Artificial Sequence; identical to SEQ ID NO: 142
  Description of Artificial Sequence: Synthetic polypeptide
  XENP30430 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S

SEQ ID NO: 542 - protein, 448 aa, Artificial Sequence; identical to SEQ ID NO: 530
  Description of Artificial Sequence: Synthetic polypeptide
  XENP30430 Chain 2 -  mAb C[PD-1]_H1_IgG1_PVA_/S267K/ S364K/E357Q

SEQ ID NO: 543 - protein, 220 aa, Artificial Sequence
  Description of Artificial Sequence: Synthetic polypeptide
  XENP30430 Chain 3 -  mAb C[PD-1]_L1.3
DIVMTQSPDSLAVSLGERATINCKSSQSLLSSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 544 - protein, 435 aa, Artificial Sequence; identical to SEQ ID NO: 138
  Description of Artificial Sequence: Synthetic polypeptide
  XENP29439 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S/M428L/N434S

SEQ ID NO: 545 - protein, 448 aa, Artificial Sequence
  Description of Artificial Sequence: Synthetic polypeptide
  XENP29439 Chain 2 -  mAb C[PD-1]_H1_IgG1_PVA_/ S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 546 - protein, 220 aa, Artificial Sequence; identical to SEQ ID NO: 522
  Description of Artificial Sequence: Synthetic polypeptide
  XENP29439 Chain 3 -  mAb C[PD-1]_L1

SEQ ID NO: 547 - protein, 435 aa, Artificial Sequence
  Description of Artificial Sequence: Synthetic polypeptide
  XENP30302 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 548 - protein, 448 aa, Artificial Sequence; identical to SEQ ID NO: 545
  Description of Artificial Sequence: Synthetic polypeptide
  XENP30302 Chain 2 -  mAb C[PD-1]_H1_IgG1_PVA_/S267K/ S364K/E357Q/M428L/N434S

SEQ ID NO: 549 - protein, 220 aa, Artificial Sequence; identical to SEQ ID NO: 522
  Description of Artificial Sequence: Synthetic polypeptide
  XENP30302 Chain 3 -  mAb C[PD-1]_L1

SEQ ID NO: 550 - protein, 435 aa, Artificial Sequence
  Description of Artificial Sequence: Synthetic polypeptide
  XENP30519 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S/M428L/N434S
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 551 - protein, 448 aa, Artificial Sequence; identical to SEQ ID NO: 545
  Description of Artificial Sequence: Synthetic polypeptide
  XENP30519 Chain 2 -  mAb C[PD-1]_H1_IgG1_PVA_/S267K/ S364K/E357Q/M428L/N434S

SEQ ID NO: 552 - protein, 220 aa, Artificial Sequence; identical to SEQ ID NO: 522
  Description of Artificial Sequence: Synthetic polypeptide
  XENP30519 Chain 3 -  mAb C[PD-1]_L1

SEQ ID NO: 553 - protein, 435 aa, Artificial Sequence; identical to SEQ ID NO: 550
  Description of Artificial Sequence: Synthetic polypeptide
  XENP30516 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S/M428L/N434S

SEQ ID NO: 554 - protein, 448 aa, Artificial Sequence; identical to SEQ ID NO: 545
  Description of Artificial Sequence: Synthetic polypeptide
  XENP30516 Chain 2 -  mAb C[PD-1]_H1_IgG1_PVA_/S267K/ S364K/E357Q/M428L/N434S

SEQ ID NO: 555 - protein, 220 aa, Artificial Sequence; identical to SEQ ID NO: 540
  Description of Artificial Sequence: Synthetic polypeptide
  XENP30516 Chain 3 -  mAb C[PD-1]_L1.1

SEQ ID NO: 556 - protein, 435 aa, Artificial Sequence; identical to SEQ ID NO: 550
  Description of Artificial Sequence: Synthetic polypeptide
  XENP30517 Chain 1 -  human_IL15Ra(sushi)_(GGGGS)5-human_ IL15(D30N/E64Q/N65D;single-chain)_Fc(216)_IgG1_pI(-)_ Isosteric_A_C220S/PVA_/S267K/L368D/K370S/M428L/N434S

SEQ ID NO: 557 - protein, 448 aa, Artificial Sequence; identical to SEQ ID NO: 545
  Description of Artificial Sequence: Synthetic polypeptide
  XENP30517 Chain 2 -  mAb C[PD-1]_H1_IgG1_PVA_/S267K/ S364K/E357Q/M428L/N434S

SEQ ID NO: 558 - protein, 220 aa, Artificial Sequence; identical to SEQ ID NO: 543
  Description of Artificial Sequence: Synthetic polypeptide
  XENP30517 Chain 3 -  mAb C[PD-1]_L1.3

SEQ ID NO: 559 - protein, 448 aa, Artificial Sequence; identical to SEQ ID NO: 521
  Description of Artificial Sequence: Synthetic polypeptide
  XENP29724 Heavy Chain -  mAb C[PD1]_H1_IgG1_PVA_/S267K

SEQ ID NO: 560 - protein, 220 aa, Artificial Sequence; identical to SEQ ID NO: 540
  Description of Artificial Sequence: Synthetic polypeptide
  XENP29724 Light Chain -  mAb C[PD1]_L1.1

SEQ ID NO: 561 - protein, 448 aa, Artificial Sequence; identical to SEQ ID NO: 521
  Description of Artificial Sequence: Synthetic polypeptide
  XENP29726 Heavy Chain -  mAb C[PD1]_H1_IgG1_PVA_/S267K

SEQ ID NO: 562 - protein, 220 aa, Artificial Sequence; identical to SEQ ID NO: 543
  Description of Artificial Sequence: Synthetic polypeptide
  XENP29726 Light Chain -  mAb C[PD1]_L1.3

SEQ ID NO: 563 - protein, 448 aa, Artificial Sequence; identical to SEQ ID NO: 521
  Description of Artificial Sequence: Synthetic polypeptide
  XENP29768 Heavy Chain -  mAb C[PD1]_H1_IgG1_PVA_/S267K

SEQ ID NO: 564 - protein, 220 aa, Artificial Sequence
  Description of Artificial Sequence: Synthetic polypeptide
  XENP29768 Light Chain -  mAb C[PD1]_L1.45
DIVMTQSPDSLAVSLGERATINCKSSQSLLNSGNQYNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 565 - protein, 448 aa, Artificial Sequence; identical to SEQ ID NO: 521
  Description of Artificial Sequence: Synthetic polypeptide
  XENP29840 Heavy Chain -  mAb C[PD1]_H1_IgG1_PVA_/S267K

SEQ ID NO: 566 - protein, 220 aa, Artificial Sequence
  Description of Artificial Sequence: Synthetic polypeptide
  XENP29840 Light Chain -  mAb C[PD1]_L1.117
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYTYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 567 - protein, 435 aa, Artificial Sequence; identical to SEQ ID NO: 136
  Description of Artificial Sequence: Synthetic polypeptide
  XENP30046 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 568 - protein, 448 aa, Artificial Sequence; identical to SEQ ID NO: 530
  Description of Artificial Sequence: Synthetic polypeptide
  XENP30046 Chain 2 -  mAb C[PD-1]_H1_IgG1_PVA_/S267K/ S364K/E357Q

SEQ ID NO: 569 - protein, 220 aa, Artificial Sequence; identical to SEQ ID NO: 540
  Description of Artificial Sequence: Synthetic polypeptide
  XENP30046 Chain 3 -  mAb C[PD-1]_L1.1

SEQ ID NO: 570 - protein, 435 aa, Artificial Sequence; identical to SEQ ID NO: 136
  Description of Artificial Sequence: Synthetic polypeptide
  XENP30047 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 571 - protein, 448 aa, Artificial Sequence; identical to SEQ ID NO: 530
  Description of Artificial Sequence: Synthetic polypeptide
  XENP30047 Chain 2 -  mAb C[PD-1]_H1_IgG1_PVA_/S267K/ S364K/E357Q

SEQ ID NO: 572 - protein, 220 aa, Artificial Sequence; identical to SEQ ID NO: 543
  Description of Artificial Sequence: Synthetic polypeptide
  XENP30047 Chain 3 -  mAb C[PD-1]_L1.3

SEQ ID NO: 573 - protein, 435 aa, Artificial Sequence; identical to SEQ ID NO: 140
  Description of Artificial Sequence: Synthetic polypeptide
  XENP30049 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 574 - protein, 448 aa, Artificial Sequence; identical to SEQ ID NO: 530
  Description of Artificial Sequence: Synthetic polypeptide
  XENP30049 Chain 2 -  mAb C[PD-1]_H1_IgG1_PVA_/S267K/ S364K/E357Q

SEQ ID NO: 575 - protein, 220 aa, Artificial Sequence; identical to SEQ ID NO: 540
  Description of Artificial Sequence: Synthetic polypeptide
  XENP30049 Chain 3 -  mAb C[PD-1]_L1.1

SEQ ID NO: 576 - protein, 435 aa, Artificial Sequence; identical to SEQ ID NO: 140
  Description of Artificial Sequence: Synthetic polypeptide
  XENP30050 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 577 - protein, 448 aa, Artificial Sequence; identical to SEQ ID NO: 530
  Description of Artificial Sequence: Synthetic polypeptide
  XENP30050 Chain 2 -  mAb C[PD-1]_H1_IgG1_PVA_/S267K/ S364K/E357Q

SEQ ID NO: 578 - protein, 220 aa, Artificial Sequence; identical to SEQ ID NO: 543
  Description of Artificial Sequence: Synthetic polypeptide
  XENP30050 Chain 3 -  mAb C[PD-1]_L1.3

SEQ ID NO: 579 - protein, 435 aa, Artificial Sequence; identical to SEQ ID NO: 136
  Description of Artificial Sequence: Synthetic polypeptide
  XENP30269 Chain 1 - human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 580 - protein, 448 aa, Artificial Sequence
  Description of Artificial Sequence: Synthetic polypeptide
  XENP30269 Chain 2 - mAb C[PD-1]_H1.19_IgG1_PVA_/S267K/ S364K/E357Q
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 581 - protein, 220 aa, Artificial Sequence; identical to SEQ ID NO: 540
  Description of Artificial Sequence: Synthetic polypeptide
  XENP30269 Chain 3 - mAb C_L1.1

SEQ ID NO: 582 - protein, 435 aa, Artificial Sequence; identical to SEQ ID NO: 136
  Description of Artificial Sequence: Synthetic polypeptide
  XENP30272 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 583 - protein, 448 aa, Artificial Sequence
  Description of Artificial Sequence: Synthetic polypeptide
  XENP30272 Chain 2 -  mAb C[PD-1]_H1.132_IgG1_PVA_/ S267K/S364K/E357Q
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGWLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 220 aa, Artificial Sequence; identical to SEQ ID NO: 540
  Description of Artificial Sequence: Synthetic polypeptide
  XENP30272 Chain 3 -  mAb C[PD-1]_L1.1

SEQ ID NO: 585 - protein, 435 aa, Artificial Sequence; identical to SEQ ID NO: 136
  Description of Artificial Sequence: Synthetic polypeptide
  XENP30273 Chain 1 - human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 586 - protein, 448 aa, Artificial Sequence
  Description of Artificial Sequence: Synthetic polypeptide
  XENP30273 Chain 2 - mAb C[PD-1]_H1.169_IgG1_PVA_/ S267K/S364K/E357Q
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 587 - protein, 220 aa, Artificial Sequence; identical to SEQ ID NO: 540
  Description of Artificial Sequence: Synthetic polypeptide
  XENP30273 Chain 3 - mAb C_L1.1

SEQ ID NO: 588 - protein, 435 aa, Artificial Sequence; identical to SEQ ID NO: 136
  Description of Artificial Sequence: Synthetic polypeptide
  XENP30274 Chain 1 - human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 589 - protein, 448 aa, Artificial Sequence
  Description of Artificial Sequence: Synthetic polypeptide
  XENP30274 Chain 2 - mAb C[PD-1]_H1.175_IgG1_PVA_/S267K/ S364K/E357Q
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGWLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 590 - protein, 220 aa, Artificial Sequence; identical to SEQ ID NO: 540
  Description of Artificial Sequence: Synthetic polypeptide
  XENP30274 Chain 3 - mAb C_L1.1

SEQ ID NO: 591 - protein, 435 aa, Artificial Sequence; identical to SEQ ID NO: 140
  Description of Artificial Sequence: Synthetic polypeptide
  XENP30275 Chain 1 - human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 592 - protein, 448 aa, Artificial Sequence; identical to SEQ ID NO: 580
  Description of Artificial Sequence: Synthetic polypeptide
  XENP30275 Chain 2 - mAb C[PD-1]_H1.19_IgG1_PVA_/S267K/ S364K/E357Q

SEQ ID NO: 593 - protein, 220 aa, Artificial Sequence; identical to SEQ ID NO: 540
  Description of Artificial Sequence: Synthetic polypeptide
  XENP30275 Chain 3 - mAb C_L1.1

SEQ ID NO: 594 - protein, 435 aa, Artificial Sequence; identical to SEQ ID NO: 140
  Description of Artificial Sequence: Synthetic polypeptide
  XENP30444 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 595 - protein, 448 aa, Artificial Sequence; identical to SEQ ID NO: 530
  Description of Artificial Sequence: Synthetic polypeptide
  XENP30444 Chain 2 -  mAb C[PD-1]_H1_IgG1_PVA_/S267K/ S364K/E357Q

SEQ ID NO: 596 - protein, 220 aa, Artificial Sequence
  Description of Artificial Sequence: Synthetic polypeptide
  XENP30444 Chain 3 -  mAb C[PD-1]_L1.135
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 597 - protein, 435 aa, Artificial Sequence; identical to SEQ ID NO: 140
  Description of Artificial Sequence: Synthetic polypeptide
  XENP30445 Chain 1 - human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 598 - protein, 448 aa, Artificial Sequence; identical to SEQ ID NO: 530
  Description of Artificial Sequence: Synthetic polypeptide
  XENP30445 Chain 2 - mAb C[PD-1]_H1_IgG1_PVA_/S267K/ S364K/E357Q

SEQ ID NO: 599 - protein, 220 aa, Artificial Sequence
  Description of Artificial Sequence: Synthetic polypeptide
  XENP30445 Chain 3 - mAb C_L1.136
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYTYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 600 - protein, 435 aa, Artificial Sequence; identical to SEQ ID NO: 140
  Description of Artificial Sequence: Synthetic polypeptide
  XENP30449 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S

SEQ ID NO: 601 - protein, 448 aa, Artificial Sequence; identical to SEQ ID NO: 530
  Description of Artificial Sequence: Synthetic polypeptide
  XENP30449 Chain 2 -  mAb C[PD-1]_H1_IgG1_PVA_/S267K/ S364K/E357Q

SEQ ID NO: 602 - protein, 220 aa, Artificial Sequence
  Description of Artificial Sequence: Synthetic polypeptide
  XENP30449 Chain 3 -  mAb C[PD-1]_L1.140
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYTYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 603 - protein, 435 aa, Artificial Sequence; identical to SEQ ID NO: 136
  Description of Artificial Sequence: Synthetic polypeptide
  XENP30486 Chain 1 - human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 604 - protein, 448 aa, Artificial Sequence; identical to SEQ ID NO: 583
  Description of Artificial Sequence: Synthetic polypeptide
  XENP30486 Chain 2 - mAb C[PD-1]_H1.132_IgG1_PVA_/S267K/ S364K/E357Q

SEQ ID NO: 605 - protein, 220 aa, Artificial Sequence; identical to SEQ ID NO: 596
  Description of Artificial Sequence: Synthetic polypeptide
  XENP30486 Chain 3 - mAb C_L1.135

SEQ ID NO: 606 - protein, 435 aa, Artificial Sequence; identical to SEQ ID NO: 136
  Description of Artificial Sequence: Synthetic polypeptide
  XENP30487 Chain 1 -  human_IL15Ra(sushi)_(GGGGS)5-human_ IL15(N4D/N65D;single-chain)_IgG1_Fc(216)_IgG1_pI(-)_ Isosteric_A_C220S/PVA_/S267K/L368D/K370S

SEQ ID NO: 607 - protein, 448 aa, Artificial Sequence; identical to SEQ ID NO: 583
  Description of Artificial Sequence: Synthetic polypeptide
  XENP30487 Chain 2 -  mAb C[PD-1]_H1.132_IgG1_PVA_/S267K/ S364K/E357Q

SEQ ID NO: 608 - protein, 220 aa, Artificial Sequence; identical to SEQ ID NO: 602
  Description of Artificial Sequence: Synthetic polypeptide
  XENP30487 Chain 3 -  mAb C[PD-1]_L1.140

SEQ ID NO: 609 - protein, 435 aa, Artificial Sequence; identical to SEQ ID NO: 136
  Description of Artificial Sequence: Synthetic polypeptide
  XENP30488 Chain 1 - human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 610 - protein, 448 aa, Artificial Sequence; identical to SEQ ID NO: 589
  Description of Artificial Sequence: Synthetic polypeptide
  XENP30488 Chain 2 - mAb C[PD-1]_H1.175_IgG1_PVA_/S267K/ S364K/E357Q

SEQ ID NO: 611 - protein, 220 aa, Artificial Sequence; identical to SEQ ID NO: 596
  Description of Artificial Sequence: Synthetic polypeptide
  XENP30488 Chain 3 - mAb C_L1.135

SEQ ID NO: 612 - protein, 435 aa, Artificial Sequence; identical to SEQ ID NO: 136
  Description of Artificial Sequence: Synthetic polypeptide
  XENP30489 Chain 1 - human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S

SEQ ID NO: 613 - protein, 448 aa, Artificial Sequence; identical to SEQ ID NO: 589
  Description of Artificial Sequence: Synthetic polypeptide
  XENP30489 Chain 2 - mAb C[PD-1]_H1.175_IgG1_PVA_/S267K/ S364K/E357Q

SEQ ID NO: 614 - protein, 220 aa, Artificial Sequence; identical to SEQ ID NO: 602
  Description of Artificial Sequence: Synthetic polypeptide
  XENP30489 Chain 3 - mAb C_L1.140

SEQ ID NO: 615 - protein, 435 aa, Artificial Sequence; identical to SEQ ID NO: 138
  Description of Artificial Sequence: Synthetic polypeptide
  XENP30290 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S/M428L/N434S

SEQ ID NO: 616 - protein, 448 aa, Artificial Sequence; identical to SEQ ID NO: 545
  Description of Artificial Sequence: Synthetic polypeptide
  XENP30290 Chain 2 -  mAb C[PD-1]_H1_IgG1_PVA_/S267K/ S364K/E357Q/M428L/N434S

SEQ ID NO: 617 - protein, 220 aa, Artificial Sequence; identical to SEQ ID NO: 540
  Description of Artificial Sequence: Synthetic polypeptide
  XENP30290 Chain 3 -  mAb C[PD-1]_L1.1

SEQ ID NO: 618 - protein, 435 aa, Artificial Sequence; identical to SEQ ID NO: 138
  Description of Artificial Sequence: Synthetic polypeptide
  XENP30291 Chain 1 -  human_IL15Ra(sushi)_(GGGGS)5-human_ IL15(N4D/N65D;single-chain)_Fc(216)_IgG1_pI(-)_ Isosteric_A_C220S/PVA_/S267K/L368D/K370S/M428L/N434S

SEQ ID NO: 619 - protein, 448 aa, Artificial Sequence; identical to SEQ ID NO: 545
  Description of Artificial Sequence: Synthetic polypeptide
  XENP30291 Chain 2 -  mAb C[PD-1]_H1_IgG1_PVA_/S267K/ S364K/E357Q/M428L/N434S

SEQ ID NO: 620 - protein, 220 aa, Artificial Sequence; identical to SEQ ID NO: 543
  Description of Artificial Sequence: Synthetic polypeptide
  XENP30291 Chain 3 -  mAb C[PD-1]_L1.3

SEQ ID NO: 621 - protein, 435 aa, Artificial Sequence; identical to SEQ ID NO: 547
  Description of Artificial Sequence: Synthetic polypeptide
  XENP30292 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S/M428L/N434S

SEQ ID NO: 622 - protein, 448 aa, Artificial Sequence; identical to SEQ ID NO: 545
  Description of Artificial Sequence: Synthetic polypeptide
  XENP30292 Chain 2 -  mAb C[PD-1]_H1_IgG1_PVA_/S267K/ S364K/E357Q/M428L/N434S

SEQ ID NO: 623 - protein, 220 aa, Artificial Sequence; identical to SEQ ID NO: 540
  Description of Artificial Sequence: Synthetic polypeptide
  XENP30292 Chain 3 -  mAb C[PD-1]_L1.1

SEQ ID NO: 624 - protein, 435 aa, Artificial Sequence; identical to SEQ ID NO: 547
  Description of Artificial Sequence: Synthetic polypeptide
  XENP30293 Chain 1 -  human_IL15Ra(sushi)_(GGGGS)5-human_ IL15(D30N/N65D;single-chain)_Fc(216)_IgG1_pI(-)_ Isosteric_A_C220S/PVA_/S267K/L368D/K370S/M428L/N434S

SEQ ID NO: 625 - protein, 448 aa, Artificial Sequence; identical to SEQ ID NO: 545
  Description of Artificial Sequence: Synthetic polypeptide
  XENP30293 Chain 2 -  mAb C[PD-1]_H1_IgG1_PVA_/S267K/ S364K/E357Q/M428L/N434S

SEQ ID NO: 626 - protein, 220 aa, Artificial Sequence; identical to SEQ ID NO: 543
  Description of Artificial Sequence: Synthetic polypeptide
  XENP30293 Chain 3 -  mAb C[PD-1]_L1.3

SEQ ID NO: 627 - protein, 350 aa, Artificial Sequence; identical to SEQ ID NO: 86
  Description of Artificial Sequence: Synthetic polypeptide
  XENP20818 Chain 1 - human_IL15_(GGGGS)1_Fc(216)_ IgG1_pI(-)_Isosteric_A_C220S/PVA_/S267K/L368D/K370S

SEQ ID NO: 628 - protein, 301 aa, Artificial Sequence; identical to SEQ ID NO: 87
  Description of Artificial Sequence: Synthetic polypeptide
  XENP20818 Chain 2 - human_IL15Ralpha(Sushi)_(GGGGS)1_Fc(216) _IgG1_C220S/PVA_/S267K/S364K/E357Q

SEQ ID NO: 629 - protein, 350 aa, Artificial Sequence
  Description of Artificial Sequence: Synthetic polypeptide
  XENP022821 Chain 1 - human_IL15_N65D_(GGGGS)1 (17692)
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 630 - protein, 301 aa, Artificial Sequence; identical to SEQ ID NO: 87
  Description of Artificial Sequence: Synthetic polypeptide
  XENP022821 Chain 2 - human_IL15Ralpha(Sushi)_(GGGGS)1_Fc (216)_IgG1_pI(-)_Isosteric_A_C220S/PVA_/S267K/L368D/K370S- Fc(216)_IgG1_C220S/PVA_/S267K/S364K/E357Q (15908)

SEQ ID NO: 631 - protein, 350 aa, Artificial Sequence
  Description of Artificial Sequence: Synthetic polypeptide
  XENP024045 Chain 1 human_IL15_D30N/E64Q/N65D_(GGGGS)1_ Fc(216)_IgG1_pI(-)_Isosteric_A_C220S/PVA_/S267K/L368D/ K370S
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 632 - protein, 301 aa, Artificial Sequence; identical to SEQ ID NO: 87
  Description of Artificial Sequence: Synthetic polypeptide
  XENP024045 Chain 2 human_IL15Ralpha(Sushi)_(GGGGS)1_ Fc(216)_IgG1_C220S/PVA_/S267K/S364K/E357Q

What is claimed is:

1. A PD-1 targeted IL-15/Rα heterodimeric Fc fusion protein comprising:
   a) a first monomer comprising, from N- to C-terminal:
      i) a IL-15 Rα sushi domain protein;
      ii) a first domain linker;
      iii) an IL-15 protein; and
      iv) a first variant Fc domain; and
   b) a second monomer comprising a heavy chain comprising VH-CH1-hinge-CH2-CH3, wherein said CH2-CH3 is a second variant Fc domain;
   c) a third monomer comprising a light chain comprising VL-CL; wherein said VH and VL domains form an antigen binding domain that binds to human PD-1 and does not compete for said human PD-1 with nivolumab and/or pembrolizumab; wherein said VH domain has at least 95% amino acid sequence identity with SEQ ID NO:5 and said VL domain has at least 95% amino acid sequence identity with SEQ ID NO:6;
   wherein said first variant Fc domain and said second variant Fc domain are each a variant of a human IgG Fc domain.

2. The PD-1 targeted IL-15/Rα heterodimeric Fc fusion protein according to claim 1 wherein said VH domain is a variant of SEQ ID NO:5 comprising the amino acid substitution F32L and said VL domain is a variant of SEQ ID NO:6 comprising the amino acid substitution N31H.

3. The PD-1 targeted IL-15/Rα heterodimeric Fc fusion protein according to claim 2 wherein said VL domain further comprises the amino acid substitutions K36Y/S99T.

4. The PD-1 targeted IL-15/Rα heterodimeric Fc fusion protein according to claim 1 wherein said VH is SEQ ID NO:5 and said VL is SEQ ID NO:6.

5. The PD-1 targeted IL-15/Rα heterodimeric Fc fusion protein according to claim 1 wherein said IL-15 protein is a variant human IL-15 protein comprising amino acid substitution(s) selected from the group of D30N/E64Q/N65D; D30N/N65D; N1D; N4D; D8N; D30N; D61N; E64Q; N65D; Q108E; N1D/N4D/D8N; N1D/N4D/N65D; N1D/D30N; N1D/D61N; N1D/D61N/E64Q/Q108E; N1D/E64Q; N1D/N65D; N1D/Q108E; N4D; N4D/D30N; N4D/D61N; N4D/D61N/N65D; N4D/D61N/E64Q/Q108E; N4D/E64Q; N4D/N65D; D8N/D61N; D8N/E64Q; D30N/E64Q; D30N/Q180E; D61N/E64Q/N65D; E64Q; E64Q/N65D; E64Q/Q108E; and N65D/Q108E.

6. The PD-1 targeted IL-15/Rα heterodimeric Fc fusion protein according to claim 1, wherein said IL-15 protein is a variant human IL-15 protein comprising amino acid substitution(s) selected from the group of N4D/N65D; D30N; D30N/E64Q; D30N/N65D; and D30N/E64Q/N65D.

7. The PD-1 targeted IL-15/Rα heterodimeric Fc fusion protein according to claim 1, wherein said first variant Fc domain and said second variant Fc domain are each a variant of a human IgG1, IgG2, or IgG4 Fc domain and comprise amino acid substitutions L368D/K370S:S364K/E357Q, according to EU numbering.

8. The PD-1 targeted IL-15/Rα heterodimeric Fc fusion protein of according to claim 1, wherein said first variant Fc domain and said second variant Fc domain are each a variant of a human IgG1 Fc domain and each comprise amino acid substitutions M428L/N434S, according to EU numbering.

9. The PD-1 targeted IL-15/Rα heterodimeric Fc fusion protein according to claim 1 wherein said VH is SEQ ID NO:5 and said VL is a variant of SEQ ID NO:6 comprising the amino acid substitution N31H.

10. A nucleic acid composition comprising:
   a) a first nucleic acid encoding the first monomer according to claim 1;
   b) a second nucleic acid encoding the second monomer according to claim 1; and
   c) a third nucleic acid encoding the third monomer according to claim 1; respectively.

11. An expression vector composition comprising:
a) an expression vector comprising the first nucleic acid of claim 10;
b) an expression vector comprising the second nucleic acid of claim 10; and
c) an expression vector comprising the third nucleic acid of claim 10.

12. A host cell comprising the expression vector composition according to claim 11.

13. A method of producing a targeted IL-15/Rα heterodimeric Fc fusion protein, the method comprising: culturing the host cell of claim 12 under conditions where said targeted IL-15/Rα heterodimeric Fc fusion protein is expressed; and recovering said protein.

* * * * *